US012590159B2

(12) United States Patent
Dubrovskaya et al.

(10) Patent No.: US 12,590,159 B2
(45) Date of Patent: Mar. 31, 2026

(54) COMPOSITIONS TARGETING EPIDERMAL GROWTH FACTOR RECEPTOR AND METHODS FOR MAKING AND USING THE SAME

(71) Applicant: Amunix Pharmaceuticals, Inc., South San Francisco, CA (US)

(72) Inventors: Viktoriya Dubrovskaya, San Francisco, CA (US); Eric Johansen, Oakland, CA (US); Sina Khorsand, El Cerrito, CA (US); Lucas Liu, San Bruno, CA (US); Volker Schellenberger, Palo Alto, CA (US); Milton To, San Lorenzo, CA (US); Tracy Young, Belmont, CA (US); André Frenzel, Braunschweig (DE); Philipp Kuhn, Braunschweig (DE)

(73) Assignee: Amunix Pharmaceuticals, Inc., South San Francisco, CA (US)

( * ) Notice: Subject to any disclaimer, the term of this patent is extended or adjusted under 35 U.S.C. 154(b) by 13 days.

(21) Appl. No.: 19/063,195

(22) Filed: Feb. 25, 2025

(65) Prior Publication Data

US 2025/0188172 A1 Jun. 12, 2025

Related U.S. Application Data

(63) Continuation of application No. 18/636,855, filed on Apr. 16, 2024, now abandoned.

(Continued)

(51) Int. Cl.
C07K 16/28 (2006.01)
A61K 39/00 (2006.01)
(Continued)

(52) U.S. Cl.
CPC .......... *C07K 16/2863* (2013.01); *A61P 35/00* (2018.01); *C07K 7/06* (2013.01);
(Continued)

(58) Field of Classification Search
CPC ........ C07K 16/2863; C07K 7/06; C07K 7/08; C07K 16/2809; C07K 2317/24;
(Continued)

(56) References Cited

U.S. PATENT DOCUMENTS

2024/0400696 A1* 12/2024 Dubrovskaya .......... A61P 35/00

FOREIGN PATENT DOCUMENTS

WO 2017040344 A2 3/2017
WO 2020264208 A1 12/2020
WO 2021263058 A1 12/2021

OTHER PUBLICATIONS

International Search Report and Written Opinion dated Sep. 26, 2024 for PCT/US2024/024741. 25 pages.

* cited by examiner

*Primary Examiner* — Mark Halvorson
*Assistant Examiner* — Lea S O'Brien
(74) *Attorney, Agent, or Firm* — Sheppard Mullin Richter & Hampton LLP

(57) ABSTRACT

The disclosure describes antibody binding domains for cluster of differentiation 3 T cell receptor (CD3), antibody binding domains for epidermal growth factor receptor (EGFR), cleavable linker sequences, and protease-activatable bispecific fusion proteins such as protease-activatable T cell engagers, as well as uses and methods of treatment.

8 Claims, 28 Drawing Sheets

Specification includes a Sequence Listing.

Related U.S. Application Data

(60) Provisional application No. 63/463,273, filed on May 1, 2023, provisional application No. 63/459,828, filed on Apr. 17, 2023.

(51) Int. Cl.

| | |
|---|---|
| *A61P 35/00* | (2006.01) |
| *C07K 7/06* | (2006.01) |
| *C07K 7/08* | (2006.01) |

(52) U.S. Cl.
CPC ............ *C07K 7/08* (2013.01); *C07K 16/2809* (2013.01); *A61K 2039/505* (2013.01); *C07K 2317/24* (2013.01); *C07K 2317/31* (2013.01); *C07K 2317/569* (2013.01); *C07K 2317/622* (2013.01); *C07K 2319/30* (2013.01); *C07K 2319/50* (2013.01)

(58) Field of Classification Search
CPC .......... C07K 2317/31; C07K 2317/569; C07K 2317/622; C07K 2319/30; C07K 2319/50; A61P 35/00; A61K 2039/505
See application file for complete search history.

FIG. 3

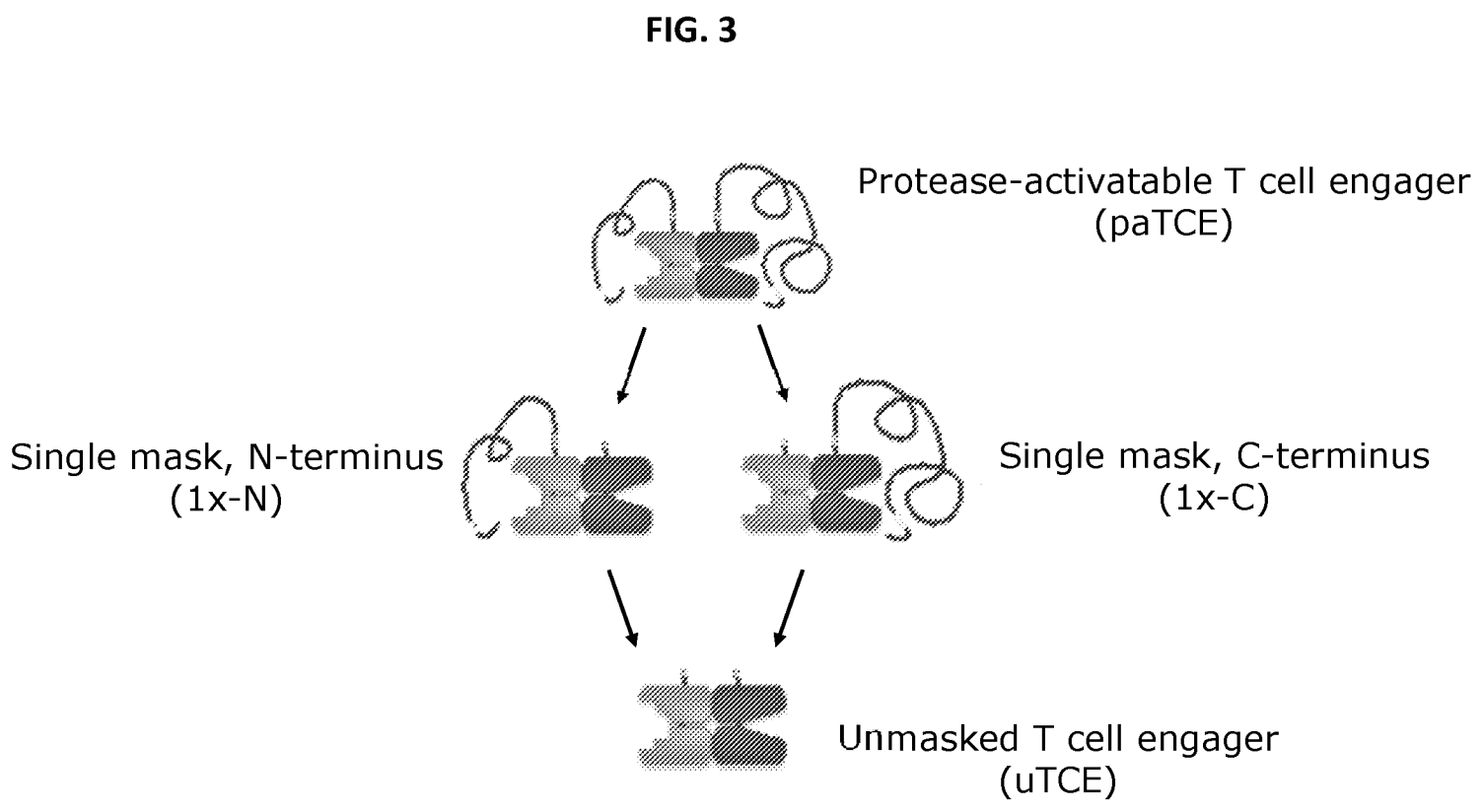

Protease-activatable T cell engager (paTCE)

Single mask, C-terminus (1x-C)

Single mask, N-terminus (1x-N)

Unmasked T cell engager (uTCE)

FIG. 4

EGFR anti-EGFR

T76N mutation in VH FW3
(H-bond with V29 in VH CDR1)

FIG. 8B

Comparing Plasmas Stability of Release Sites

Comparing % cleavage of release sites

Plasma:tumor ratios by cell line

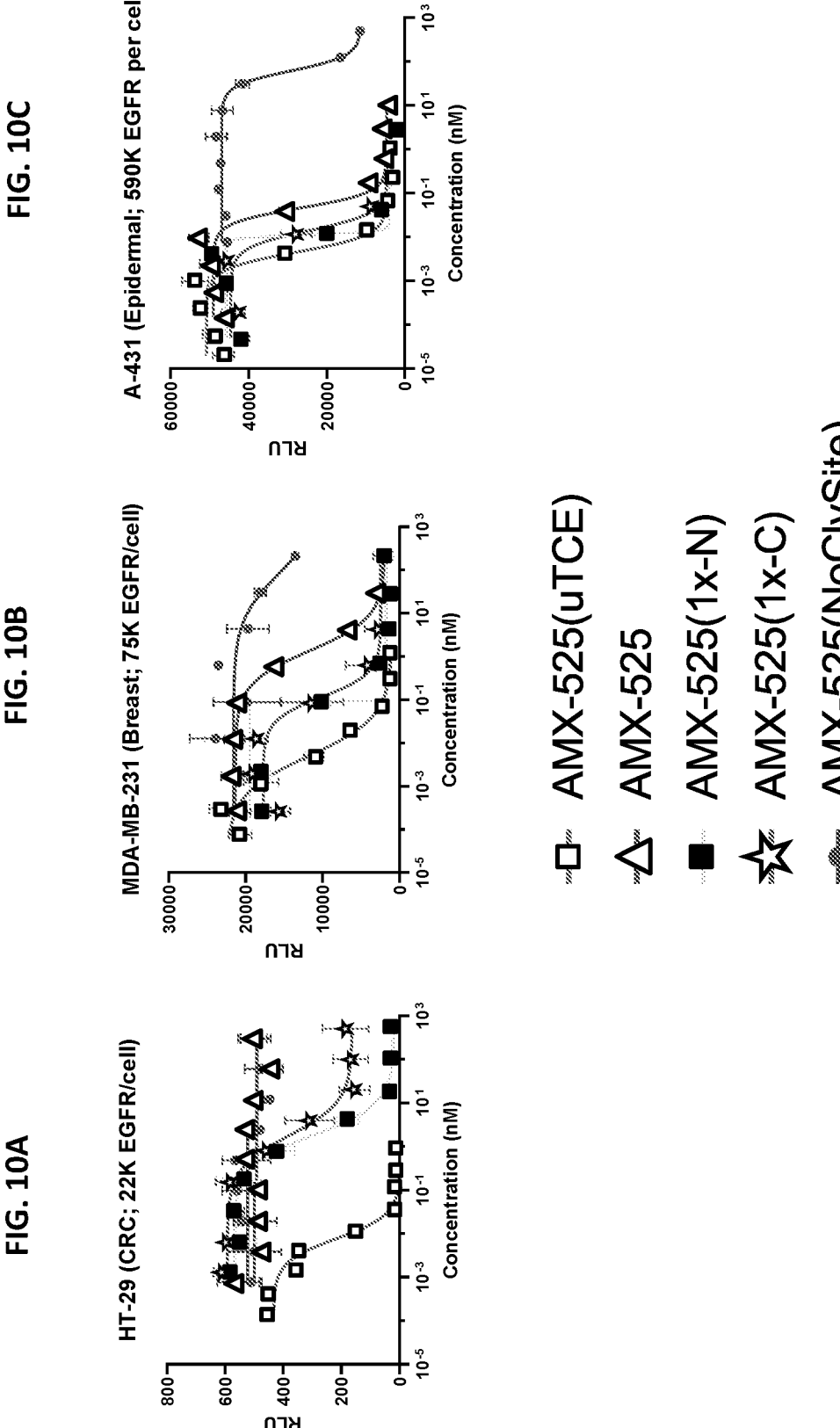

TNFα

IFNγ

HT-29 Cells (22K EGFR/cell)

AMX-525(uTCE)
AMX-525
AMX-525(NoClvSite)
AMX-525(1x-N)
AMX-525(1x-C)

HT-29 (CRC; 22K EGFR/cell)

A. Diluent w/o PBMCs
B. Diluent w/ PBMCs
C. AMX-525(uTCE)(0.3 mpk QW)
D. AMX-525(0.5 mpk QW)
E. AMX-525(1.0 mpk QW)
F. AMX-525(3 mpk QW)
G. AMX-525(3 mpk BIW)
H. AMX-525(NoClvSite)(3 mpk QW)

FIG. 16
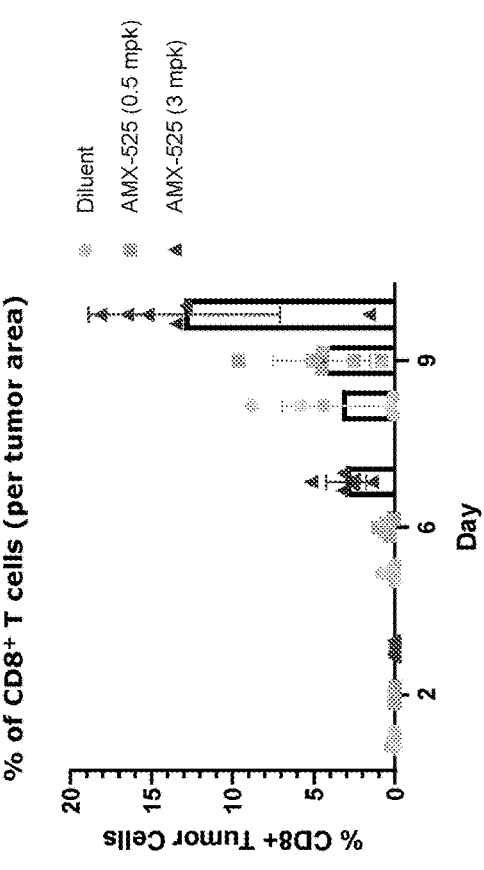
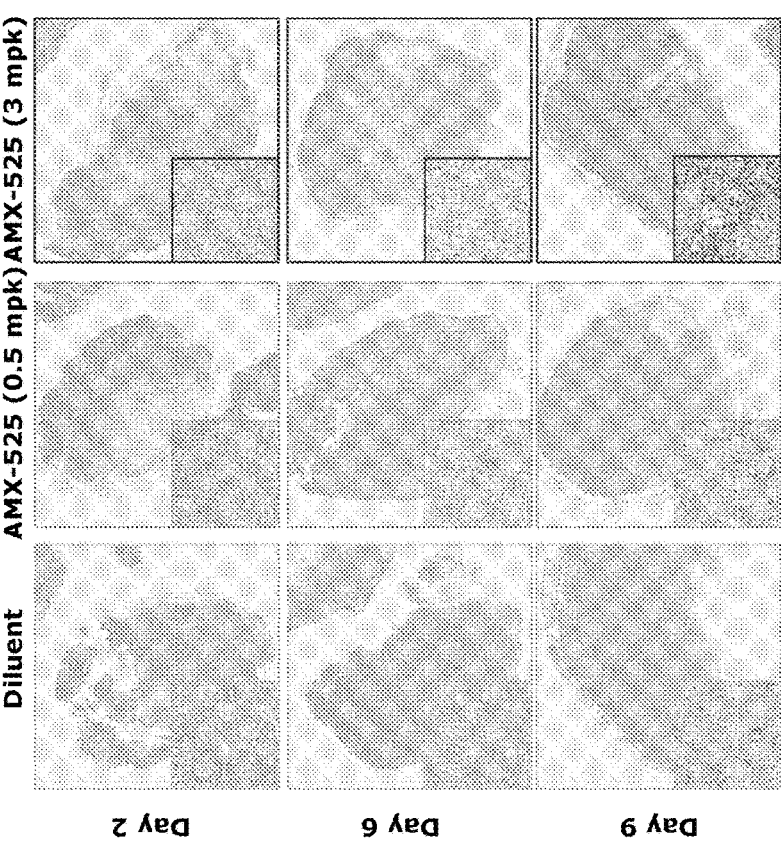

FIG. 17
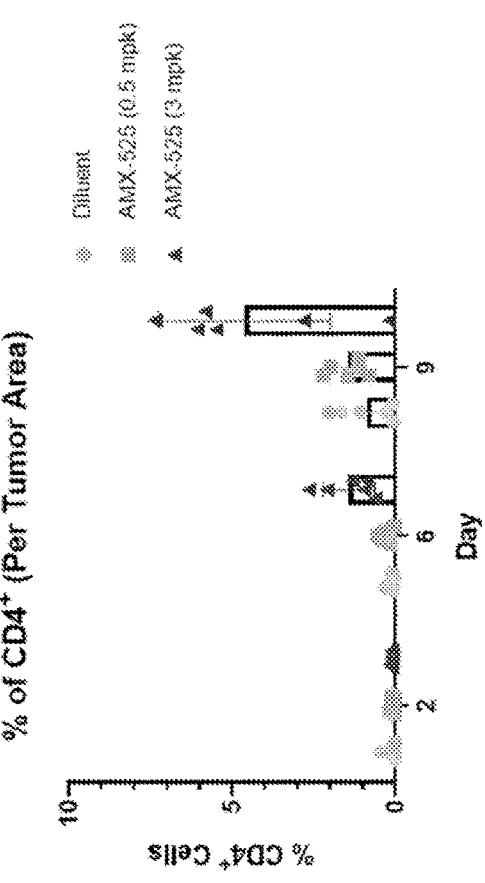
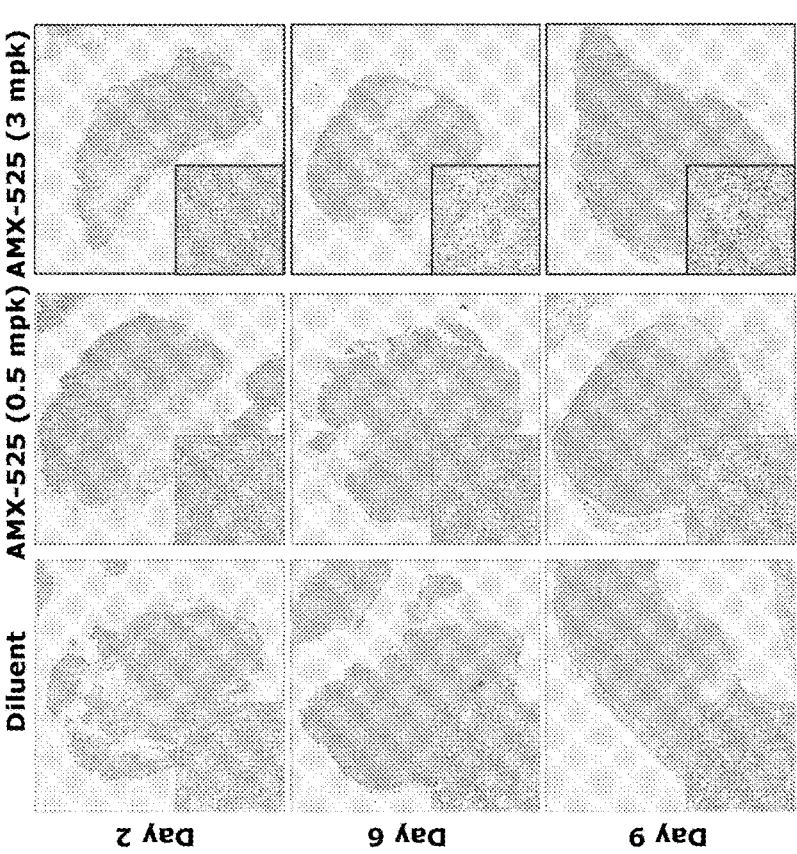

Diluent (Day 9)

AMX-525 (3 mg/kg; Day 9)

MDA-MB-231 (Breast; 75K EGFR/cell)

A. No PBMCs (QW)
B. Diluent, PBMCs (QW)
D. AMX-525 (uTCE) (0.1 mpk, QW)
E. AMX-525 (0.1 mpk, QW)
F. AMX-525 (0.5 mpk, QW)
G. AMX-525 (2.0 mpk, QW)

Time (Day Post Tumor Injection)

Tumor Volume (mm³ +/- SEM)

COMPOSITIONS TARGETING EPIDERMAL GROWTH FACTOR RECEPTOR AND METHODS FOR MAKING AND USING THE SAME

CROSS-REFERENCE TO RELATED APPLICATIONS

This application is a continuation of U.S. application Ser. No. 18/636,855, filed Apr. 16, 2024, which claims priority to U.S. Provisional Patent Application Ser. No. 63/459,828, filed Apr. 17, 2023; and 63/463,273, filed May 1, 2023; the contents of which are hereby incorporated by reference in their entireties.

SEQUENCE LISTING

The instant application contains a Sequence Listing which has been submitted electronically in XML format and is hereby incorporated by reference in its entirety. Said XML file, created on Feb. 25, 2025, is named 385484.xml and is 2,959,226 bytes in size.

BACKGROUND

The epidermal growth factor receptor (EGFR), also known as also known as ErbB1 and HER1, is a receptor tyrosine kinase that is involved in cell proliferation. The overexpression or aberrant activity of EGFR is associated with numerous cancers and is therefore an attractive target for therapeutic intervention. While approved therapies exist, their utility can be hampered by toxicity and/or low stability.

There is a long-felt and yet unmet need for therapeutic intervention of tumors that express EGFR, including stable antibody-based therapeutics that have an improved therapeutic index.

BRIEF DESCRIPTION

The present disclosure provides, among other things, antigen-binding molecules with binding specificity to EGFR, antigen-binding molecules with binding specificity to CD3, as well as bispecific antigen-binding molecules that bind both EGFR and CD3 for use in therapeutic settings in which specific targeting and T cell-mediated killing of EGFR-expressing cells is desired. Aspects disclosed herein address a long-felt unmet need for EGFR-targeting cancer therapeutics, including T cell engagers (TCEs) that have an increased therapeutic index. Aspects of the present disclosure also address the long-felt and yet unmet need for the therapeutic intervention of immunologically cold tumors, e.g., solid tumors, that express EGFR.

In one aspect, the disclosure provides a chimeric polypeptide comprising a bispecific antibody domain, wherein the bispecific antibody domain comprises a first antigen binding domain that specifically binds epidermal growth factor receptor (EGFR) and a second antigen binding domain that binds to cluster of differentiation 3 T cell receptor (CD3), wherein the first antigen binding domain comprises: a VH domain comprising a CDR1 amino acid sequence of GGSVSSGDYYWT (SEQ ID NO: 562), a CDR2 amino acid sequence of HIYYSGNTNYNPSLKS (SEQ ID NO: 563), and a CDR3 amino acid sequence of DRVTGAFDI (SEQ ID NO: 564); and at least one of: a proline (P) residue at position 40 in FR2 (alternately referred to as amino acid residue 42 relative to SEQ ID NO: 450), a valine (V) residue at position in position 67 in FR3 (alternately referred to as amino acid residue 69 relative to SEQ ID NO: 450), a valine (V) residue at position 71 in FR3 (alternately referred to as amino acid residue 73 relative to SEQ ID NO: 450), an asparagine (N) residue at position 76 in FR3 (alternately referred to as amino acid residue 78 relative to SEQ ID NO: 450), a valine (V) residue at position 89 in FR3 (alternately referred to as amino acid residue 94 relative to SEQ ID NO: 450), an alanine (A) residue at position 93 in FR3 (alternately referred to as amino acid residue 98 relative to SEQ ID NO: 450), and/or a leucine (L) residue at position 108 in FR4 (alternately referred to as amino acid residue 114 relative to SEQ ID NO: 450), wherein the FR numbering is according to Kabat; and a VL domain comprising a CDR1 amino acid sequence of QASQDISNYLN (SEQ ID NO: 565), a CDR2 amino acid sequence of DASNLET (SEQ ID NO: 566), a CDR3 amino acid sequence of QHFDHLPLA (SEQ ID NO: 567); and wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or EGFR, and wherein the protease-cleavable release segment is cleavable by at least one protease that is present in a tumor.

In some embodiments, the VH domain comprises an asparagine (N) residue at position 76 in FR3. In some embodiments, the VH domain comprises alanine (A) residue at position 93 in FR3. In some embodiments, the VH domain comprises a valine (V) residue at position in position 67 in FR3, a valine (V) residue at position 71 in FR3, an asparagine (N) residue at position 76 in FR3, a valine (V) residue at position 89 in FR3, and an alanine (A) residue at position 93 in FR3. In some embodiments, the VH domain comprises a proline (P) residue at position 40 in FR2, a valine (V) residue at position in position 67 in FR3, a valine (V) residue at position 71 in FR3, an asparagine (N) residue at position 76 in FR3, a valine (V) residue at position 89 in FR3, an alanine (A) residue at position 93 in FR3, and a leucine (L) residue at position 108 in FR4.

In some embodiments, the VL domain comprises at least one of: a tyrosine (Y) residue at position 87 in FR3 (alternately referred to as amino acid residue 87 relative to SEQ ID NO: 451) and/or a glutamine (Q) residue at position 100 in FR4 (alternately referred to as amino acid residue 100 relative to SEQ ID NO: 451), wherein the FR numbering is according to Kabat. In some embodiments, the VL domain comprises a tyrosine (Y) residue at position 87 in FR3 and a glutamine (Q) residue at position 100 in FR4.

In some embodiments, the VH domain comprises an amino acid sequence of QVQLQX$_1$X$_2$GX$_3$GLX$_4$KPSETLSLTCX$_5$VX$_6$GGSVSSG DYYWTWIRQPPGKGLEWIGHIYYSGNTN YNPSLKSRVTISVDTSKNQFSLKLSSVTAADTAVYY-CARDRVTGAFDIWGQGTLVTVSS, wherein X$_1$ corresponds to E or Q; X$_2$ corresponds to S or W; X$_3$ corresponds to P or A; X$_4$ corresponds to V or L; X$_5$ corresponds to T or A; and X$_6$ corresponds to S or Y (SEQ ID NO: 576); and the VL domain comprises an amino acid sequence of X$_1$X$_2$X$_3$TQSPX$_4$X$_5$LSX$_6$SX$_7$GX$_8$RX$_9$TX$_{10}$X$_{11}$CQASQDI SNYLNWYQQKPGX$_{12}$APX$_{13}$LLIYDASNLET GX$_{14}$PX$_{15}$RFSGSGSGTDFTX$_{16}$TISX$_{17}$LX$_{18}$PEDX$_{19}$AX$_{20}$ YYCQHFDHLPLAFGQGTKVEIK, wherein X$_1$ corresponds to D or E; X$_2$ corresponds to Q or V; X$_3$ corresponds to M or L; X$_4$ corresponds to S. G, or A; X$_5$ corresponds to S or T; X$_6$ corresponds to L or A; X$_7$ corresponds to P or V; $X_8$ corresponds to D or E; $X_9$ corresponds to V or A; $X_{10}$ corresponds to I or L; $X_{11}$ corresponds to T or S; $X_{12}$ corresponds to K or Q; $X_{13}$ corresponds to K or R; $X_{14}$ corresponds to V or I; $X_{15}$ corresponds to S. D. or A; $X_{16}$ corresponds to F or L; $X_{17}$ corresponds to S or R; $X_{18}$ corresponds to Q or E; $X_{19}$ corresponds to I or F; and $X_{20}$ corresponds to T or V (SEQ ID NO: 577).

In one aspect, the disclosure provides a chimeric polypeptide comprising a bispecific antibody domain, wherein the bispecific antibody domain comprises a first antigen binding domain that specifically binds to epidermal growth factor receptor (EGFR) and a second antigen binding domain that binds to cluster of differentiation 3 T cell receptor (CD3), wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or EGFR, wherein the protease-cleavable release segment is not capable of being cleaved by legumain in human plasma, or wherein legumain cleaves the protease-cleavable release segment in human plasma at a rate that is less than about 25% of the rate that RSR-2295 (EAGRSANHTPAGLTGP) (SEQ ID NO:7048) is cleaved by legumain.

In one aspect, the disclosure provides a chimeric polypeptide comprising a bispecific antibody domain, wherein the bispecific antibody domain comprises a first antigen binding domain that specifically binds epidermal growth factor receptor (EGFR) and a second antigen binding domain that binds to cluster of differentiation 3 T cell receptor (CD3), wherein the chimeric polypeptide has a melting temperature ($T_m$) of greater than 62° C. and/or a thermostability ratio of greater than 0.5 at 62° C.; wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or EGFR, and wherein the protease-cleavable release segment is cleavable by at least one protease that is present in a tumor.

In some embodiments, the Tm is determined by differential scanning fluorimetry (DSF).

In some embodiments, the thermostability ratio is determined by: i) incubating an input amount of a chimeric polypeptide at 62° C. for 30 minutes thereby denaturing a fraction of the input amount of chimeric polypeptide; ii) measuring an amount of monomeric chimeric polypeptide remaining following step i); and iii) dividing the amount of monomeric chimeric polypeptide by the input amount of the chimeric polypeptide to generate the thermostability ratio.

In some embodiments, the amount of monomeric chimeric polypeptide is measured by mass spectrometry.

In one aspect, the disclosure provides a chimeric polypeptide comprising a bispecific antibody domain, wherein the bispecific antibody domain comprises a first antigen binding domain that specifically binds a cancer cell antigen and a second antigen binding domain that binds to cluster of differentiation 3 T cell receptor (CD3), wherein the second antigen binding domain comprises: a VH domain comprising a CDR1 amino acid sequence of GFTFSTYAMN (SEQ ID NO: 12), a CDR2 amino acid sequence of RIRTKRN-DYATYYADSVKG (SEQ ID NO: 14), and a CDR3 amino acid sequence of HENFGNSYVSWFAH (SEQ ID NO: 10); and a VL domain comprising a CDR1 amino acid sequence of RSSNGAVTSSNYAN (SEQ ID NO: 1), a CDR2 amino acid sequence of GTNKRAP (SEQ ID NO: 4), and a CDR3 amino acid sequence of ALWYPNLWV (SEQ ID NO: 6), wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or the cancer cell antigen, and wherein the protease-cleavable release segment is cleavable by at least one protease that is present in a tumor.

In some embodiments, the second antigen binding domain comprises: (i) the VL domain comprising the amino acid sequence of ELVVTQEPSLTVSPGGTVTLTCRSSN-GAVTSSNYANWVQQKPGQAPRGLIGGTNKRAPGT-PARF SGSLLEGKAALTLSGVQPEDEAVYY-CALWYPNLWVFGGGTKLTVL (SEQ ID NO: 127); and (ii) the VH domain comprising the amino acid sequence of

```
                                    (SEQ ID NO: 126)
EVOLVESGGGIVQPGGSLRLSCAASGFTFSTYAMNWVRQAPGK

GLEWVGRIRTKRNDYATYYADSVKGRFTISRDDSKNTLYLQMN

SLKTEDTAVYYCVRHENFGNSYVSWFAHWGQGTLVTVSS.
```

In some embodiments, the cancer cell antigen is human alpha 4 integrin, Ang2, B7-H3, B7-H6, CEACAM5, cMET, CTLA4, FOLR1, EpCAM, CCR5, CD19, EGFR, HER2, HER3, HER4, PD-L1, prostate-specific membrane antigen (PSMA), CEA, MUC1 (mucin), MUC-2, MUC3, MUC4, MUC5AC, MUC5B, MUC7, MUC16 BhCG, Lewis-Y, CD20, CD33, CD38, CD30, CD56 (NCAM), CD133, ganglioside GD3; 9—O-Acetyl-GD3, GM2, Globo H, fucosyl GM1, GD2, carbonicanhydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Müellerian inhibitory substance receptor type II (MIS-IIR), sialylated Tn antigen (sTN), fibroblast activation antigen (FAP), endosialin (CD248), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, or EphA2.

In some embodiments, the cancer cell antigen is EGFR.

In some embodiments, chimeric polypeptide comprises a structural arrangement from the N-terminal side to the C-terminal side defined as: (first antigen binding domain)-(second antigen binding domain)-(linker)-(mask polypeptide), (second antigen binding domain)-(first antigen binding domain)-(linker)-(mask polypeptide), (mask polypeptide)-(linker)-(first antigen binding domain)-(second antigen binding domain), or (mask polypeptide)-(linker)-(second antigen binding domain)-(first antigen binding domain), wherein each—is a covalent connection or a polypeptide linker.

In some embodiments, the mask polypeptide is an extended length non-natural polypeptide (ELNN).

In some embodiments, the linker further comprises a spacer.

In some embodiments, the protease-cleavable release segment is fused to the bispecific antibody domain via the spacer.

In some embodiments, the spacer is characterized in that: (i) at least 90% of its amino acids are glycine (G), alanine (A), serine(S), threonine (T), glutamate (E), proline (P), or any combination thereof; and (ii) it comprises at least 3 types of amino acids selected from the group consisting of G, A, S, T, E, and P.

In some embodiments, the spacer is from 9 to 14 amino acids in length.

In some embodiments, the spacer comprises at least 4 types of amino acids selected from the group consisting of G, A, S, T, E, and P.

In some embodiments, the amino acids of the spacer consists of A, E, G, S, P, and/or T.

In some embodiments, the spacer is cleavable by a non-mammalian protease.

In some embodiments, the non-mammalian protease is Glu-C.

In some embodiments, the spacer comprises an amino acid sequence having at least 85%, 90%, 91%, 92%, 93%, 94%, 95%, 96%, 97%, 98%, or 99% identity, or 100% identity, to a sequence listed in Table C.

In some embodiments, the spacer comprises an amino acid sequence that has at least 85%, 90%, 91%, 92%, 93%, 94%, 95%, 96%, 97%, 98%, or 99% identity, or 100% identity, to GTSESATPES (SEQ ID NO: 96) or GTATPESGPG (SEQ ID NO:97).

In some embodiments, the protease-cleavable release segment comprises an amino acid sequence comprising the sequence: EAGRSAXHTPAGLTGP (SEQ ID NO: 7627), wherein X is any amino acid other than N. In some embodiments, X is S.

In some embodiments, chimeric polypeptide comprises a first mask polypeptide joined to the first antigen binding domain via a first linker wherein the first linker comprises a first protease cleavable release segment (RS1) cleavable by at least one protease present in a tumor; and a second mask polypeptide joined to the second antigen binding domain via a second linker wherein the second linker comprises a second protease cleavable release segment (RS2) cleavable by at least one protease present in a tumor.

In some embodiments, chimeric polypeptide comprises a structural arrangement from the N-terminal side to the C-terminal side defined as: (Mask1)-(Linker1)-(first antigen binding domain)-(second antigen binding domain)-(Linker2)-(Mask2), (Mask1)-(Linker1)-(second antigen binding domain)-(first antigen binding domain)-(Linker2)-(Mask2), (Mask2)-(Linker2)-(first antigen binding domain)-(second antigen binding domain)-(Linker1)-(Mask1), or (Mask2)-(Linker2)-(second antigen binding domain)-(first antigen binding domain)-(Linker1)-(Mask1), wherein each—is, individually, a covalent bond or a polypeptide linker.

In some embodiments, the first mask polypeptide is a first ELNN (ELNN1) and the second mask polypeptide is a second ELNN (ELNN2).

In some embodiments, chimeric polypeptide comprises a structural arrangement from the N-terminal side to the C-terminal side defined as: (ELNN1)-(Linker1)-(first antigen binding domain)-(second antigen binding domain)-(Linker2)-(ELNN2), (ELNN1)-(Linker1)-(second antigen binding domain)-(first antigen binding domain)-(Linker2)-(ELNN2), (ELNN2)-(Linker2)-(first antigen binding domain)-(second antigen binding domain)-(Linker1)-(ELNN1), or (ELNN2)-(Linker2)-(second antigen binding domain)-(first antigen binding domain)-(Linker1)-(ELNN1), wherein each—is, individually, a covalent bond or a polypeptide linker.

In some embodiments, Linker1 further comprises a first spacer (Spacer1).

In some embodiments, Linker2 further comprises a second spacer (Spacer2).

In some embodiments, RS1 is fused to the bispecific antibody domain via Spacer1 and/or RS2 is fused to the bispecific antibody domain via Spacer2.

In some embodiments, chimeric polypeptide comprises a structural arrangement from the N-terminal side to the C-terminal side defined as: (ELNN1)-(RS1)-(Spacer1)-(first antigen binding domain)-(second antigen binding domain)-(Spacer2)-(RS2)-(ELNN2), (ELNN1)-(RS1)-(Spacer1)-(second antigen binding domain)-(first antigen binding domain)-(Spacer2)-(RS2)-(ELNN2), (ELNN2)-(RS2)-(Spacer2)-(first antigen binding domain)-(second antigen binding domain)-(Spacer1)-(RS1)-(ELNN1), or (ELNN2)-(RS2)-(Spacer2)-(second antigen binding domain)-(first antigen binding domain)-(Spacer1)-(RS1)-(ELNN1), wherein each—is a, individually, covalent bond or a polypeptide linker.

In some embodiments, Spacer 1 and/or the Spacer2 is characterized in that: (i) at least 90% of its amino acids are glycine (G), alanine (A), serine(S), threonine (T), glutamate (E), proline (P), or any combination thereof; and (ii) it comprises at least 3 types of amino acids selected from the group consisting of G, A, S, T, E, and P.

In some embodiments, Spacer 1 and/or the Spacer2 is from 9 to 14 amino acids in length.

In some embodiments, Spacer 1 and/or the Spacer2 comprises at least 4 types of amino acids selected from the group consisting of G, A, S, T, E, and P.

In some embodiments, the amino acids of Spacer1 and/or the Spacer2 consists of A, E, G, S, P, and/or T.

In some embodiments, Spacer 1 and/or the Spacer2 comprises an amino acid sequence having at least 85%, 90%, 91%, 92%, 93%, 94%, 95%, 96%, 97%, 98%, or 99% identity, or 100% identity, to a sequence listed in Table C.

In some embodiments, Spacer 1 and/or the Spacer2 comprises an amino acid sequence that has at least 85%, 90%, 91%, 92%, 93%, 94%, 95%, 96%, 97%, 98%, or 99% identity, or 100% identity, to GTSESATPES (SEQ ID NO:96) or GTATPESGPG (SEQ ID NO:97).

In some embodiments, the amino acid sequence of the first ELNN is between 250 amino acids and 350 amino acids in length, and wherein the amino acid sequence of the second ELNN is between 500 amino acids and 600 amino acids in length.

In some embodiments, the amino acid sequence of the first ELNN is 294 amino acids in length, and wherein the amino acid sequence of the second ELNN is 582 amino acids in length.

In some embodiments, RS1 and/or RS2 comprises an amino acid sequence comprising the sequence: EAGRSAXHTPAGLTGP (SEQ ID NO: 7627), wherein X is any amino acid other than N. In some embodiments, X is S.

In one aspect, the disclosure provides a chimeric polypeptide comprising a bispecific antibody domain, wherein the bispecific antibody domain comprises a first antigen binding domain that has binding specificity to a cancer cell antigen, and a second antigen binding domain that has binding specificity to an effector cell antigen expressed on an effector cell, wherein the chimeric polypeptide further comprises a first ELNN joined to the first antigen binding domain via a first linker comprising a first protease-cleavable release segment (RS1) positioned between the first ELNN and the first antigen binding domain such that the first ELNN is capable of reducing the binding of the first antigen binding domain to the cancer cell antigen, wherein the RS1 is cleavable by at least one protease that is present in a tumor, wherein the chimeric polypeptide further comprises a second ELNN joined to the second antigen binding domain via a second linker comprising second protease-cleavable release segment (RS2) positioned between the second ELNN and the second antigen binding domain such that the second ELNN is capable of reducing the binding of the first antigen binding domain to the effector cell antigen, wherein the RS2 is cleavable by at least one protease that is present in a tumor, wherein the first ELNN has a shorter amino acid sequence than the second ELNN, and wherein the cancer cell antigen is EGFR.

In some embodiments, chimeric polypeptide comprises a structural arrangement from the N-terminal side to the C-terminal side defined as: (ELNN1)-(Linker1)-(first antigen binding domain)-(second antigen binding domain)-(Linker2)-(ELNN2), (ELNN1)-(Linker1)-(second antigen binding domain)-(first antigen binding domain)-(Linker2)-(ELNN2), (ELNN2)-(Linker2)-(first antigen binding domain)-(second antigen binding domain)-(Linker1)-(ELNN1), or (ELNN2)-(Linker2)-(second antigen binding domain)-(first antigen binding domain)-(Linker1)-(ELNN1), wherein each—is, individually, a covalent bond or a polypeptide linker.

In some embodiments, Linker1 further comprises a first spacer (Spacer 1).

In some embodiments, Linker2 further comprises a second spacer (Spacer2).

In some embodiments, RS1 is fused to the bispecific antibody domain via Spacer1 and/or RS2 is fused to the bispecific antibody domain via Spacer2.

In some embodiments, the chimeric polypeptide comprises a structural arrangement from the N-terminal side to the C-terminal side defined as: (ELNN1)-(RS1)-(Spacer1)-(first antigen binding domain)-(second antigen binding domain)-(Spacer2)-(RS2)-(ELNN2), (ELNN1)-(RS1)-(Spacer1)-(second antigen binding domain)-(first antigen binding domain)-(Spacer2)-(RS2)-(ELNN2), (ELNN2)-(RS2)-(Spacer2)-(first antigen binding domain)-(second antigen binding domain)-(Spacer1)-(RS1)-(ELNN1), or (ELNN2)-(RS 2)-(Spacer2)-(second antigen binding domain)-(first antigen binding domain)-(Spacer1)-(RS1)-(ELNN1), wherein each—is a, individually, covalent bond or a polypeptide linker.

In one aspect, the disclosure provides a chimeric polypeptide comprising a bispecific antibody domain, comprising the formulas that comprises from the N-terminal side to the C-terminal side: Formula 1: (Mask1)-(RS1)-(Spacer1)-(first antigen binding domain)-[antibody domain linker]-(second antigen binding domain); Formula 2: (first antigen binding domain)-[antibody domain linker]-(second antigen binding domain)-(Spacer2)-(RS2)-(Mask2); or Formula 3: (Mask1)-(RS1)-(Spacer1)-(first antigen binding domain)-[antibody domain linker]-(second antigen binding domain)-(Spacer2)-(RS2)-(Mask2), wherein, the first antigen binding domain has binding specificity to a cancer cell antigen; the second antigen binding domain has binding specificity to an effector cell antigen expressed on an effector cell; each—comprises, individually, a covalent connection or a polypeptide linker; the Mask1 is a polypeptide that is capable of reducing binding of the first antigen binding domain to its target; the Mask2 is a polypeptide that is capable of reducing binding of the second antigen binding domain to its target; if the chimeric polypeptide comprises Formula I then the Spacer1 consists of A, E, G, S. P, and/or T residues, if the chimeric polypeptide comprises Formula 2 then the Spacer2 consists of A, E, G, S. P. and/or T residues, and if the chimeric polypeptide comprises Formula 3 then the Spacer1 and/or the Spacer2 consists of A, E, G. S. P. and/or T residues; and wherein the cancer cell antigen is EGFR.

In some embodiments, each—is, individually, a covalent connection. In some embodiments, each—is, individually, a covalent bond. In some embodiments, each—is a peptide bond. In some embodiments, each—is, individually, a polypeptide linker of no more than 5 amino acids.

In some embodiments, the second antigen binding domain has binding specificity to human CD3 and cynomolgus monkey CD3. In some embodiments, the second antigen binding domain has binding specificity to human CD3. In some embodiments, the effector cell antigen is cluster of differentiation 3 T cell receptor (CD3). In some embodiments, the CD3 is CD3 epsilon, CD3 delta, CD3 gamma, or CD3 zeta. In some embodiments, the CD3 is CD3 epsilon.

In some embodiments, the Mask1 is a first ELNN and the Mask2 is a second ELNN.

In some embodiments, the Spacer 1 and/or the Spacer2 is characterized in that: (i) at least 90% of its amino acids are glycine (G), alanine (A), serine(S), threonine (T), glutamate (E), proline (P), or any combination thereof; and (ii) it comprises at least 3 types of amino acids selected from the group consisting of G, A, S. T, E, and P.

In some embodiments, the Spacer 1 and/or the Spacer2 is from 9 to 14 amino acids in length.

In some embodiments, the Spacer 1 and/or the Spacer2 comprises at least 4 types of amino acids selected from the group consisting of G. A. S. T. E, and P.

In some embodiments, the amino acids of the Spacer1 and/or the Spacer2 consists of A, E, G, S, P, and/or T.

In some embodiments, the Spacer1 and/or the Spacer2 is cleavable by a non-mammalian protease.

In some embodiments, the non-mammalian protease is Glu-C.

In some embodiments, the Spacer1 and/or the Spacer 2 comprises an amino acid sequence having at least 85%, 90%, 91%, 92%, 93%, 94%, 95%, 96%, 97%, 98%, or 99% identity, or 100% identity, to a sequence listed in Table C.

In some embodiments, the Spacer1 and/or the Spacer 2 comprises an amino acid sequence that has at least 85%, 90%, 91%, 92%, 93%, 94%, 95%, 96%, 97%, 98%, or 99% identity, or 100% identity, to GTSESATPES (SEQ ID NO:96) or GTATPESGPG (SEQ ID NO:97).

In some embodiments, the amino acid sequence of the first ELNN is at least 100 amino acids shorter than the amino acid sequence of the second ELNN.

In some embodiments, the amino acid sequence of the first ELNN is at least 200 amino acids shorter than the amino acid sequence of the second ELNN.

In some embodiments, the amino acid sequence of the first ELNN is at least 250 amino acids shorter than the amino acid sequence of the second ELNN.

In some embodiments, the amino acid sequence of the first ELNN is between 250 amino acids and 350 amino acids in length, and wherein the amino acid sequence of the second ELNN is between 500 amino acids and 600 amino acids in length.

In some embodiments, the amino acid sequence of the first ELNN is 294 amino acids in length, and wherein the amino acid sequence of the second ELNN is 582 amino acids in length.

In some embodiments, the first antigen binding domain comprises a first antibody or an antigen-binding fragment thereof, and wherein the second antigen binding domain comprises a second antibody or an antigen-binding fragment thereof.

In some embodiments, the first antigen binding domain is a Fab, an scFv, or an ISVD.

In some embodiments, the second antigen binding domain is a Fab, an scFV, or an ISVD.

In some embodiments, the ISVD is a VHH domain.

In some embodiments, the first antigen binding domain is an scFV.

In some embodiments, the second antigen binding domain is an scFV.

In some embodiments, there is an antibody domain linker between the first antigen binding domain and the second antigen binding domain.

In some embodiments, the antibody domain linker comprises an amino acid sequence having at least 85%, 90%, 91%, 92%, 93%, 94%, 95%, 96%, 97%, 98%, or 99% identity, or 100% identity, to a sequence listed in Table A or B.

In some embodiments, the antibody domain linker consists of G and S amino residues.

In some embodiments, the antibody domain linker is 6-12 residues in length.

In some embodiments, the antibody domain linker comprises the amino acid sequence

```
                                    (SEQ ID NO: 87)
        GGGGS
        or
                                    (SEQ ID NO: 125)
        GGGGSGGGS.
```

In some embodiments, the first antigen binding domain and/or the second antigen binding domain comprise an scFv comprising a VL domain, a VH domain, and a linker between the VL domain and the VH domain, wherein the linker consists of A, E, G, S, P, and/or T residues.

In some embodiments, the linker is characterized in that: (i) at least 90% of its amino acids are glycine (G), alanine (A), serine(S), threonine (T), glutamate (E), proline (P), or any combination thereof; and (ii) it comprises at least 3 types of amino acids selected from the group consisting of G, A, S, T, E, and P.

In some embodiments, the linker between the VL domain and the VH domain is from 25 to 35 amino acids in length.

In some embodiments, the linker between the VL domain and the VH domain comprises at least 4 types of amino acids selected from the group consisting of G, A, S, T, E, and P.

In some embodiments, the amino acids of the linker between the VL domain and the VH domain consists of A, E, G, S, P, and/or T.

In some embodiments, the linker between the VL domain and the VH domain is cleavable by a non-mammalian protease.

In some embodiments, the non-mammalian protease is Glu-C.

In some embodiments, the linker between the VL domain and the VH domain comprises an amino acid sequence that has at least 85%, 90%, 91%, 92%, 93%, 94%, 95%, 96%, 97%, 98%, or 99% identity, or 100% identity, to SESAT-PESGPGTSPGATPESGPGTSESATP (SEQ ID NO: 81).

In some embodiments, the second antigen binding domain comprises the following CDRs: a VL domain CDR1 with an amino acid sequence that has at least 85%, 90%, 91%, 92%, 93%, 94%, 95%, 96%, 97%, 98%, or 99% identity, or 100% identity, to RSSX$_1$GAVTX$_2$SNYAN (SEQ ID NO:8023), wherein X$_1$ corresponds to T or N, and X$_2$ corresponds to T or S; a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL domain CDR3 with an amino acid sequence that has at least 85%, 90%, 91%, 92%, 93%, 94%, 95%, 96%, 97%, 98%, or 99% identity, or 100% identity, to ALWYX$_4$NLWV (SEQ ID NO:8024), wherein X$_4$ corresponds to S or P; a VH domain CDR1 with an amino acid sequence that has at least 85%, 90%, 91%, 92%, 93%, 94%, 95%, 96%, 97%, 98%, or 99% identity, or 100% identity, to GFTFX$_8$TYAMN (SEQ ID NO:8025), wherein X$_8$ corresponds to S or N; a VH domain CDR2 with an amino acid sequence that has at least 85%, 90%, 91%, 92%, 93%, 94%, 95%, 96%, 97%, 98%, or 99% identity, or 100% identity, to RIRX$_{10}$KX$_{11}$NX$_{12}$YATYYADSVKX$_{13}$ (SEQ ID NO: 8026), wherein X$_{10}$ corresponds to T or S. X$_{11}$ corresponds to R or Y, X$_{12}$ corresponds to D or N, and X$_{13}$ corresponds to G or D; a VH domain CDR3 with an amino acid sequence that has at least 85%, 90%, 91%, 92%, 93%, 94%, 95%, 96%, 97%, 98%, or 99% identity, or 100% identity, to HX$_{14}$NFGNSYVSWFAX$_{15}$ (SEQ ID NO:8027), wherein X$_{14}$ corresponds to E or G, and X$_{15}$ corresponds to H or Y.

In some embodiments, the second antigen binding domain comprises: a VH domain comprising a CDR1 amino acid sequence of GFTFSTYAMN (SEQ ID NO: 12), a CDR2 amino acid sequence of RIRTKRNDYATYYADSVKG (SEQ ID NO: 14), and a CDR3 amino acid sequence of HENFGNSYVSWFAH (SEQ ID NO: 10); and a VL domain comprising a CDR1 amino acid sequence of RSSN-GAVTSSNYAN (SEQ ID NO: 1), a CDR2 amino acid sequence of GTNKRAP (SEQ ID NO: 4), and a CDR3 amino acid sequence of ALWYPNLWV (SEQ ID NO: 6).

In some embodiments, the second antigen binding domain comprises: a VH domain comprising an amino acid sequence of EVOLVESGGGIVQPGGSLRLSCAASGFTF-STYAMNWVRQAPGKGLEWVGRIRTKRNDYATYYA DSVKGRFTISRDDSKNTLYLQMNSLKTED-TAVYYCVRHENFGNSYVSWFAHWGQGTLVTVSS (SEQ ID NO: 126); and a VL domain comprising an amino acid sequence of

```
                                    (SEQ ID NO: 127)
    ELVVTQEPSLTVSPGGTVTLTCRSSNGAVTSSNYANWVQQKPGQ

APRGLIGGTNKRAPGTPARFSGSLLEGKAALTLSGVQPEDEAVY

YCALWYPNLWVFGGGTKLTVL
```

In some embodiments, the first antigen binding domain comprises the following CDRs: a VL domain CDR1 with an amino acid sequence that has at least 85%, 90%, 91%, 92%, 93%, 94%, 95%, 96%, 97%, 98%, or 99% identity, or 100% identity, to QASQDISNYLN (SEQ ID NO:565); a VL domain CDR2 with an amino acid sequence that has at least 85%, 90%, 91%, 92%, 93%, 94%, 95%, 96%, 97%, 98%, or 99% identity, or 100% identity, to DASNLET (SEQ ID NO:566); a VL domain CDR3 with an amino acid sequence that has at least 85%, 90%, 91%, 92%, 93%, 94%, 95%, 96%, 97%, 98%, or 99% identity, or 100% identity, to QHFDHLPLA (SEQ ID NO:567); a VH domain CDR1 with an amino acid sequence that has at least 85%, 90%, 91%, 92%, 93%, 94%, 95%, 96%, 97%, 98%, or 99% identity, or 100% identity, to GGSVSSGDYYWT (SEQ ID NO:562); a VH domain CDR2 with an amino acid sequence that has at least 85%, 90%, 91%, 92%, 93%, 94%, 95%, 96%, 97%, 98%, or 99% identity, or 100% identity, to HIYYSGNTNYNPSLKS (SEQ ID NO:563); and a VH domain CDR3 with an amino acid sequence that has at least 85%, 90%, 91%, 92%, 93%, 94%, 95%, 96%, 97%, 98%, or 99% identity, or 100% identity, to DRVTGAFDI (SEQ ID NO:564).

In some embodiments, the VH domain comprises at least one of: a proline (P) residue at position 40 in FR2, a valine (V) residue at position in position 67 in FR3, a valine (V) residue at position 71 in FR3, an asparagine (N) residue at position 76 in FR3, a valine (V) residue at position 89 in FR3, an alanine (A) residue at position 93 in FR3, and/or a leucine (L) residue at position 108 in FR4, wherein the FR numbering is according to Kabat. In some embodiments, the VH domain comprises an asparagine (N) residue at position 76 in FR3. In some embodiments, the VH domain comprises alanine (A) residue at position 93 in FR3. In some embodiments, the VH domain comprises a valine (V) residue at position in position 67 in FR3, a valine (V) residue at position 71 in FR3, an asparagine (N) residue at position 76 in FR3, a valine (V) residue at position 89 in FR3, and an alanine (A) residue at position 93 in FR3. In some embodiments, the VH domain comprises a proline (P) residue at position 40 in FR2, a valine (V) residue at position in position 67 in FR3, a valine (V) residue at position 71 in FR3, an asparagine (N) residue at position 76 in FR3, a valine (V) residue at position 89 in FR3, an alanine (A) residue at position 93 in FR3, and a leucine (L) residue at position 108 in FR4.

In some embodiments, the VL domain comprises at least one of: a tyrosine (Y) residue at position 87 in FR3 and/or a glutamine (Q) residue at position 100 in FR4, wherein the FR numbering is according to Kabat. In some embodiments, the VL domain comprises a tyrosine (Y) residue at position 87 in FR3 and a glutamine (Q) residue at position 100 in FR4.

In some embodiments, the first antigen binding domain comprises a VH domain comprising an amino acid sequence of SEQ ID NO: 576 and a VL domain comprising an amino acid sequence of SEQ ID NO: 577.

In some embodiments, the first antigen binding domain comprises: i) a VH domain comprising an amino acid sequence of SEQ ID NO: 468 and a VL domain comprising an amino acid sequence of SEQ ID NO: 469; ii) a VH domain comprising an amino acid sequence of SEQ ID NO: 466 and a VL domain comprising an amino acid sequence of SEQ ID NO: 467; iii) a VH domain comprising an amino acid sequence of SEQ ID NO: 490 and a VL domain comprising an amino acid sequence of SEQ ID NO: 491; iv) a VH domain comprising an amino acid sequence of SEQ ID NO: 492 and a VL domain comprising an amino acid sequence of SEQ ID NO: 493; v) a VH domain comprising an amino acid sequence of SEQ ID NO: 514 and a VL domain comprising an amino acid sequence of SEQ ID NO: 515; vi) a VH domain comprising an amino acid sequence of SEQ ID NO: 516 and a VL domain comprising an amino acid sequence of SEQ ID NO: 517; vii) a VH domain comprising an amino acid sequence of SEQ ID NO: 538 and a VL domain comprising an amino acid sequence of SEQ ID NO: 539; or viii) a VH domain comprising an amino acid sequence of SEQ ID NO: 540 and a VL domain comprising an amino acid sequence of SEQ ID NO: 541.

In some embodiments, the VL domain is N-terminal to the VH domain. In some embodiments, the VL domain is C-terminal to the VH domain.

In some embodiments, the second antigen binding domain comprises a scFV comprising an amino acid sequence that has at least 85%, 90%, 91%, 92%, 93%, 94%, 95%, 96%, 97%, 98%, or 99% identity, or 100% identity, to:

```
                                      (SEQ ID NO: 128)
ELVVTQEPSLTVSPGGTVTLTCRSSNGAVTSSNYANWVQQKPGQAPRGL

IGGTNKRAPGTPARFSGSLLEGKAALTLSGVQPEDEAVYYCALWYPNLW

VFGGGTKLTVLSESATPESGPGTSPGATPESGPGTSESATPEVQLVESG

GGIVQPGGSLRLSCAASGFTFSTYAMNWVRQAPGKGLEWVGRIRTKRND

YATYYADSVKGRFTISRDDSKNTLYLQMNSLKTEDTAVYYCVRHENFGN

SYVSWFAHWGQGTLVTVSS.
```

In some embodiments, the first antigen binding domain comprises a scFV comprising an amino acid sequence that has at least 85%, 90%, 91%, 92%, 93%, 94%, 95%, 96%, 97%, 98%, or 99% identity, or 100% identity, to:

```
                                      (SEQ ID NO: 449)
DIQMTQSPSSLSASVGDRVTITCQASQDISNYLNWYQQKPGKAPKLLIY

DASNLETGVPSRFSGSGSGTDFTFTISSLQPEDIATYYCQHFDHLPLAF

GQGTKVEIKSESATPESGPGTSPGATPESGPGTSESATPQVQLQESGPG

LVKPSETLSLTCTVSGGSVSSGDYYWTWIRQPPGKGLEWIGHIYYSGNT

NYNPSLKSRVTISVDTSKNQFSLKLSSVTAADTAVYYCARDRVTGAFDI

WGQGTLVTVSS.
```

In some embodiments, the RS comprises a protease cleavage site is cleavable by at least one protease listed in Table 6.

In some embodiments, the RS comprises an amino acid sequence having at least 85%, 90%, 91%, 92%, 93%, 94%, 95%, 96%, 97%, 98%, or 99% identity, or 100% identity, to a sequence listed in Table 7a.

In some embodiments, the RS is cleavable by uPA, ST14, MMP2, MMP7, MMP9, and MMP14.

In some embodiments, the RS is not cleavable by legumain.

In some embodiments, the RS is not cleavable by legumain in human blood, plasma, or serum.

In some embodiments, the RS is not cleavable upon incubation with about 1 nM or less legumain for about 20 hours.

In some embodiments, the RS is not cleavable upon incubation with about 1 nM or less legumain for about 20 hours in human blood, plasma, or serum.

In some embodiments, legumain cleaves the RS in human plasma at a rate that is less than about 50% of the rate that RSR-2295 (EAGRSANHTPAGLTGP) (SEQ ID NO:7048) is cleaved by legumain.

In some embodiments, legumain cleaves the RS in human plasma at a rate that is less than about 25% of the rate that RSR-2295 (EAGRSANHTPAGLTGP) (SEQ ID NO:7048) is cleaved by legumain.

In some embodiments, legumain cleaves the RS in human plasma at a rate that is less than about 10% of the rate that RSR-2295 (EAGRSANHTPAGLTGP) (SEQ ID NO:7048) is cleaved by legumain.

In some embodiments, legumain cleaves the RS in human plasma at a rate that is less than about 5% of the rate that RSR-2295 (EAGRSANHTPAGLTGP) (SEQ ID NO:7048) is cleaved by legumain.

In some embodiments, legumain cleaves the RS in human plasma at a rate that is less than about 2.5% of the rate that RSR-2295 (EAGRSANHTPAGLTGP) (SEQ ID NO:7048) is cleaved by legumain.

In some embodiments, the RS1 and/or RS2 comprises protease cleavage is cleavable by at least one protease listed in Table 6.

In some embodiments, the RS1 and/or RS2 comprises an amino acid sequence having at least 85%, 90%, 91%, 92%, 93%, 94%, 95%, 96%, 97%, 98%, or 99% identity, or 100% identity, to a sequence listed in Table 7a.

In some embodiments, the RS1 and/or RS2 is cleavable by uPA, ST14, MMP2, MMP7, MMP9, and MMP14.

In some embodiments, the RS1 and/or RS2 is not cleavable by legumain.

In some embodiments, the RS1 and/or RS2 is not cleavable by legumain in human blood, plasma, or serum.

In some embodiments, the RS1 and/or RS2 is not cleavable upon incubation with about 1 nM or less legumain for about 20 hours.

In some embodiments, the RS1 and/or RS2 is not cleavable upon incubation with about 1 nM or less legumain for about 20 hours in human blood, plasma, or serum.

In some embodiments, legumain cleaves the RS1 and/or RS2 in human plasma at a rate that is less than about 50% of the rate that RSR-2295 (EAGRSANHTPAGLTGP) (SEQ ID NO:7048) is cleaved by legumain.

In some embodiments, legumain cleaves the RS1 and/or RS2 in human plasma at a rate that is less than about 25% of the rate that RSR-2295 (EAGRSANHTPAGLTGP) (SEQ ID NO:7048) is cleaved by legumain.

In some embodiments, legumain cleaves the RS1 and/or RS2 in human plasma at a rate that is less than about 10% of the rate that RSR-2295 (EAGRSANHTPAGLTGP) (SEQ ID NO:7048) is cleaved by legumain.

In some embodiments, legumain cleaves the RS1 and/or RS2 in human plasma at a rate that is less than about 5% of the rate that RSR-2295 (EAGRSANHTPAGLTGP) (SEQ ID NO:7048) is cleaved by legumain.

In some embodiments, legumain cleaves the RS1 and/or RS2 in human plasma at a rate that is less than about 2.5% of the rate that RSR-2295 (EAGRSANHTPAGLTGP) (SEQ ID NO:7048) is cleaved by legumain.

In some embodiments, the RS1 comprises a protease-cleavable amino acid sequence comprising the sequence: EAGRSAXHTPAGLTGP (SEQ ID NO: 7627), wherein X is any amino acid other than N.

In some embodiments, the RS2 comprises a protease-cleavable amino acid sequence comprising the sequence: EAGRSAXHTPAGLTGP (SEQ ID NO: 7627), wherein X is any amino acid other than N.

In some embodiments, RS1 and/or RS2 comprises a protease-cleavable amino acid sequence comprising the sequence: EAGRSASHTPAGLTGP (SEQ ID NO: 7628).

In some embodiments, the RS1 and the RS2 are the same.

In some embodiments, the RS1 and the RS2 are different.

In some embodiments, the first ELNN and the second ELNN are each individually characterized in that: (i) at least 90% of each of the first ELNN's and the second ELNN's amino acids are glycine (G), alanine (A), serine(S), threonine (T), glutamate (E), proline (P), or any combination thereof; and (ii) each comprises at least 3 types of amino acids selected from the group consisting of G, A. S. T. E, and P.

In some embodiments, the first ELNN and the second ELNN are each individually further characterized in that: (i) each comprises at least 100 amino acid residues; (ii) each comprises a plurality of non-overlapping sequence motifs that are each from 9 to 14 amino acids in length, wherein the plurality of non-overlapping sequence motifs comprise a set of non-overlapping sequence motives, wherein each non-overlapping sequence motive of the set of non-overlapping sequence motifs is repeated at least two times in the ELNN.

In some embodiments, the plurality of non-overlapping sequence motifs comprises at least one non-overlapping sequence motif that occurs only once within the ELNN.

In some embodiments, the non-overlapping sequence motifs comprise one of or any combination of the sequence motifs listed in Table 1.

In some embodiments, the non-overlapping sequence motifs comprise at least 2, 3, or 4 of the sequence motifs listed in Table 1.

In some embodiments, the non-overlapping sequence motifs comprise any one of or any combination of GTSTEPSEGSAP (SEQ ID NO:189), GTSESATPESGP (SEQ ID NO:188), GSGPGTSESATP (SEQ ID NO:8028), GSEPATSGSETP (SEQ ID NO:187), GSPAGSPTSTEE (SEQ ID NO: 186), and GTSPSATPESGP (SEQ ID NO:8029).

In some embodiments, each of the first ELNN and the second ELNN comprises at least 4 types of amino acids selected from the group consisting of G. A. S. T. E, and P.

In some embodiments, the amino acids of each of the first ELNN and the second ELNN consists of A, E, G, S, P, and/or T.

In some embodiments, the amino acid sequence of the first ELNN is at least 100 amino acids shorter than the amino acid sequence of the second ELNN. In some embodiments, the amino acid sequence of the first ELNN is at least 200 amino acids shorter than the amino acid sequence of the second ELNN. In some embodiments, the amino acid sequence of the first ELNN is at least 250 amino acids shorter than the amino acid sequence of the second ELNN. In some embodiments, the amino acid sequence of the first ELNN is between 250 amino acids and 350 amino acids in length, and wherein the amino acid sequence of the second ELNN is between 500 amino acids and 600 amino acids in length. In some embodiments, the amino acid sequence of the first ELNN is 294 amino acids in length, and wherein the amino acid sequence of the second ELNN is 582 amino acids in length.

In some embodiments, the first ELNN and/or the second ELNN comprises an amino acid sequence that is at least 85% identical to an amino acid sequence listed in Table 3a or 3b.

In some embodiments, the first ELNN comprises an amino acid sequence that has at least 85%, 90%, 91%, 92%, 93%, 94%, 95%, 96%, 97%, 98%, or 99% identity, or 100% identity, to:

```
                                    (SEQ ID NO: 8021)
ASSATPESGPGTSTEPSEGSAPGTSESATPESGPGSGPGTSESATPGTS

ESATPESGPGSEPATSGSETPGTSESATPESGPGTSTEPSEGSAPGSPA

GSPTSTEEGTSESATPESGPGSEPATSGSETPGTSESATPESGPGSPAG

SPTSTEEGSPAGSPTSTEEGTSTEPSEGSAPGTSESATPESGPGTSESA

TPESGPGTSESATPESGPGSEPATSGSETPGSEPATSGSETPGSPAGSP

TSTEEGTSTEPSEGSAPGTSTEPSEGSAPGSEPATSGSETPGTSESAT

P.
```

In some embodiments, the second ELNN comprises an amino acid sequence that has at least 85%, 90%, 91%, 92%, 93%, 94%, 95%, 96%, 97%, 98%, or 99% identity, or 100% identity, to:

```
                                      (SEQ ID NO: 8022)
ATPESGPGTSESATPESGPGSPAGSPTSTEEGTSESATPESGPGSEPAT

SGSETPGTSESATPESGPGTSTEPSEGSAPGTSTEPSEGSAPGTSTEPS

EGSAPGTSTEPSEGSAPGTSTEPSEGSAPGTSTEPSEGSAPGSPAGSPT

STEEGTSTEPSEGSAPGTSESATPESGPGSEPATSGSETPGTSESATPE

SGPGSEPATSGSETPGTSESATPESGPGTSTEPSEGSAPGTSESATPES

GPGSPAGSPTSTEEGSPAGSPTSTEEGSPAGSPTSTEEGTSESATPESG

PGTSTEPSEGSAPGTSESATPESGPGSEPATSGSETPGTSESATPESGP

GSEPATSGSETPGTSESATPESGPGTSTEPSEGSAPGSPAGSPTSTEEG

TSESATPESGPGSEPATSGSETPGTSESATPESGPGSPAGSPTSTEEGS

PAGSPTSTEEGTSTEPSEGSAPGTSESATPESGPGTSESATPESGPGTS

PSATPESGPGSEPATSGSETPGSEPATSGSETPGSPAGSPTSTEEGTST

EPSEGSAPGTSTEPSEGSAPGSEPATSGSETPGTSESAGEPEA.
```

In some embodiments, the chimeric polypeptide comprises one or more barcode fragments.

In some embodiments, the chimeric polypeptide comprises two or more barcode fragments.

In some embodiments, each barcode fragment is different from every other barcode fragment.

In some embodiments, each barcode fragment differs in both sequence and molecular weight from all other peptide fragments that are releasable from the chimeric polypeptide upon complete digestion the chimeric polypeptide by a non-mammalian protease.

In some embodiments, the non-mammalian protease is Glu-C.

In some embodiments, the chimeric polypeptide comprises a Glu-C cleavage site comprising one of the following amino acid sequences: ATPESGPG (SEQ ID NO:8030). SGSETPGT (SEQ ID NO:8031), and GTSESATP (SEQ ID NO:8032).

In some embodiments, the chimeric polypeptide comprises at least one of the following amino acid sequences:
SGPE.SGPGX$_n$SGPE.SGPG (SEQ ID NO:8033).
SGPE.SGPGX$_n$ATPE.SGPG (SEQ ID NO: 8034).
SGPE.SGPGX$_n$GTSE.SATP (SEQ ID NO:8036).
SGPE.SGPGX$_n$TTPE.SGPG (SEQ ID NO: 8037).
SGPE.SGPGX$_n$STPE.SGPG (SEQ ID NO:8038).
SGPE.SGPGX$_n$GTPE.SGPG (SEQ ID NO: 8039).
SGPE.SGPGX$_n$GTPE.TPGS (SEQ ID NO:8040).
SGPE.SGPGX$_n$GTPE.TPGS (SEQ ID NO:8040).
SGPE.SGPGX$_n$SGSE.TGTP (SEQ ID NO:8041),
SGPE.SGPGX$_n$GTPE.GSAP (SEQ ID NO:8042).
SGPE.SGPGX$_n$EPSE.SATP (SEQ ID NO:8043).
ATPE.SGPGX$_n$SGPE.SGPG (SEQ ID NO:8044).
ATPE.SGPGX$_n$ATPE.SGPG (SEQ ID NO:8045),
ATPE.SGPGX$_n$GTSE.SATP (SEQ ID NO: 8047).
ATPE.SGPGX$_n$TTPE.SGPG (SEQ ID NO:8049).
ATPE.SGPGX$_n$STPE.SGPG (SEQ ID NO: 8051).
ATPE.SGPGX$_n$GTPE.SGPG (SEQ ID NO: 8053).
ATPE.SGPGX$_n$GTPE.TPGS (SEQ ID NO: 8055).
ATPE.SGPGX$_n$SGSE.TGTP (SEQ ID NO:8056),
ATPE.SGPGX$_n$GTPE.GSAP (SEQ ID NO: 8057).
ATPE.SGPGX$_n$EPSE.SATP (SEQ ID NO:8058), GTS- E.SATPX$_n$SGPE.SGPG (SEQ ID NO: 8059). GTS-E.SATPX$_n$ATPE.SGPG (SEQ ID NO:8060), GTS-E.SATPX$_n$GTSE.SATP (SEQ ID NO: 8061). GTSE.SATPX$_n$TTPE.SGPG (SEQ ID NO:8062). GTS-E.SATPX$_n$STPE.SGPG (SEQ ID NO: 8063). GTS-E.SATPX$_n$GTPE.SGPG (SEQ ID NO:8064), GTS-E.SATPX$_n$GTPE.TPGS (SEQ ID NO: 8065). GTSE.SATPX$_n$SGSE.TGTP (SEQ ID NO:8066). GTS-E.SATPX$_n$GTPE.GSAP (SEQ ID NO: 8067). GTS-E.SATPX$_n$EPSE.SATP (SEQ ID NO:8068). TTPE.SGPGX$_n$SGPE.SGPG (SEQ ID NO: 8069). TTPE.SGPGX$_n$ATPE.SGPG (SEQ ID NO:8070). TTPE.SGPGX$_n$GTSE.SATP (SEQ ID NO: 8071). TTPE.SGPGX$_n$TTPE.SGPG (SEQ ID NO:8072). TTPE.SGPGX$_n$STPE.SGPG (SEQ ID NO: 8074). TTPE.SGPGX$_n$GTPE.SGPG (SEQ ID NO:8075). TTPE.SGPGX$_n$GTPE.TPGS (SEQ ID NO: 8076). TTPE.SGPGX$_n$SGSE.TGTP (SEQ ID NO:8077). TTPE.SGPGX$_n$GTPE.GSAP (SEQ ID NO: 8078). TTPE.SGPGX$_n$EPSE.SATP (SEQ ID NO:8079), STPE.SGPGX$_n$SGPE.SGPG (SEQ ID NO: 8080). STPE.SGPGX$_n$ATPE.SGPG (SEQ ID NO:8081), STPE.SGPGX$_n$GTSE.SATP (SEQ ID NO: 8082). STPE.SGPGX$_n$TTPE.SGPG (SEQ ID NO:8083). STPE.SGPGX$_n$STPE.SGPG (SEQ ID NO: 8084). STPE.SGPGX$_n$GTPE.SGPG (SEQ ID NO:8086). STPE.SGPGX$_n$GTPE.TPGS (SEQ ID NO: 8087). STPE.SGPGX$_n$SGSE.TGTP (SEQ ID NO:8088). STPE.SGPGX$_n$GTPE.GSAP (SEQ ID NO: 8089). STPE.SGPGX$_n$EPSE.SATP (SEQ ID NO:8090). GTPE.SGPGX$_n$SGPE.SGPG (SEQ ID NO: 8091). GTPE.SGPGX$_n$ATPE.SGPG (SEQ ID NO:8092), GTPE.SGPGX$_n$GTSE.SATP (SEQ ID NO: 8093). GTPE.SGPGX$_n$TTPE.SGPG (SEQ ID NO:8094). GTPE.SGPGX$_n$STPE.SGPG (SEQ ID NO: 8096). GTPE.SGPGX$_n$GTPE.SGPG (SEQ ID NO:8098). GTPE.SGPGX$_n$GTPE.TPGS (SEQ ID NO: 8100). GTPE.SGPGX$_n$SGSE.TGTP (SEQ ID NO:8101). GTPE.SGPGX$_n$GTPE.GSAP (SEQ ID NO: 8102). GTPE.SGPGX$_n$EPSE.SATP (SEQ ID NO:8103), GTPE.TPGSX$_n$SGPE.SGPG (SEQ ID NO: 8104). GTPE.TPGSX$_n$ATPE.SGPG (SEQ ID NO:8105), GTPE.TPGSX$_n$GTSE.SATP (SEQ ID NO: 8106). GTPE.TPGSX$_n$TTPE.SGPG (SEQ ID NO:8107), GTPE.TPGSX$_n$STPE.SGPG (SEQ ID NO: 8108). GTPE.TPGSX$_n$GTPE.SGPG (SEQ ID NO:8109). GTPE.TPGSX$_n$GTPE.TPGS (SEQ ID NO: 8110). GTPE.TPGSX$_n$SGSE.TGTP (SEQ ID NO:8111), GTPE.TPGSX$_n$GTPE.GSAP (SEQ ID NO: 8113), GTPE.TPGSX$_n$EPSE.SATP (SEQ ID NO:8114), SGSE.TGTPX$_n$SGPE.SGPG (SEQ ID NO: 8115). SGSE.TGTPX$_n$ATPE.SGPG (SEQ ID NO:8116). SGSE.TGTPX$_n$GTSE.SATP (SEQ ID NO: 8117). SGSE.TGTPX$_n$TTPE.SGPG (SEQ ID NO:8118). SGSE.TGTPX$_n$STPE.SGPG (SEQ ID NO: 8119). SGSE.TGTPX$_n$GTPE.SGPG (SEQ ID NO:8120). SGSE.TGTPX$_n$GTPE.TPGS (SEQ ID NO: 8121). SGSE.TGTPX$_n$SGSE.TGTP (SEQ ID NO:8122). SGSE.TGTPX$_n$GTPE.GSAP (SEQ ID NO: 8123). SGSE.TGTPX$_n$EPSE.SATP (SEQ ID NO:8124). GTPE.GSAPX$_n$SGPE.SGPG (SEQ ID NO: 8125), GTPE.GSAPX$_n$ATPE.SGPG (SEQ ID NO:8126). GTPE.GSAPX$_n$GTSE.SATP (SEQ ID NO: 8127). GTPE.GSAPX$_n$TTPE.SGPG (SEQ ID NO:8128), GTPE.GSAPX$_n$STPE.SGPG (SEQ ID NO: 8129). GTPE.GSAPX$_n$GTPE.SGPG (SEQ ID NO:8130), GTPE.GSAPX$_n$GTPE.TPGS (SEQ ID NO: 8131).

GTPE.GSAPX$_n$SGSE.TGTP (SEQ ID NO:8132), GTPE.GSAPX$_n$GTPE.GSAP (SEQ ID NO: 8133). GTPE.GSAPX$_n$EPSE.SATP (SEQ ID NO:8134). EPSE.SATPX$_n$SGPE.SGPG (SEQ ID NO: 8136). EPSE.SATPX$_n$ATPE.SGPG (SEQ ID NO:8137). EPSE.SATPX$_n$GTSE.SATP (SEQ ID NO: 8138). EPSE.SATPX$_n$TTPE.SGPG (SEQ ID NO:8139). EPSE.SATPX$_n$STPE.SGPG (SEQ ID NO: 8140). EPSE.SATPX$_n$GTPE.SGPG (SEQ ID NO:8141). EPSE.SATPX$_n$GTPE.TPGS (SEQ ID NO: 8142). EPSE.SATPX$_n$SGSE.TGTP (SEQ ID NO:8143). EPSE.SATPX$_n$GTPE.GSAP (SEQ ID NO: 8144), or EPSE.SATPX$_n$EPSE.SATP (SEQ ID NO:8145), wherein each "." is a Glu-C cleavage site and n is any integer from 0 to 50.

In some embodiments, the chimeric polypeptide comprises at least one of the following amino acid sequences: SGPE.SGPGX$_n$ATPE.SGPG (SEQ ID NO:8035). ATPE.SGPGX$_n$GTSE.SATP (SEQ ID NO: 8048). ATPE.SGPGX$_n$TTPE.SGPG (SEQ ID NO:8050), ATPE.SGPGX$_n$STPE.SGPG (SEQ ID NO: 8052). ATPE.SGPGX$_n$ATPE.SGPG (SEQ ID NO:8046), ATPE.SGPGX$_n$GTPE.SGPG (SEQ ID NO: 8054). ATPE.SGPGX$_n$GTPE.SGPG (SEQ ID NO:8054). ATPE.SGPGX$_n$ATPE.SGPG (SEQ ID NO: 8046). GTPE.SGPGX$_n$GTPE.SGPG (SEQ ID NO:8099). GTPE.SGPGX$_n$STPE.SGPG (SEQ ID NO: 8097). GTPE.SGPGX$_n$TTPE.SGPG (SEQ ID NO:8095), GTPE.SGPGX$_n$STPE.SGPG (SEQ ID NO: 8097). GTPE.TPGSX$_n$SGSE.TGTP (SEQ ID NO:8112), GTPE.GSAPX$_n$EPSE.SATP (SEQ ID NO: 8135), ATPE.SGPGX$_n$GTPE.SGPG (SEQ ID NO:8054), ATPE.SGPGX$_n$GTPE.SGPG (SEQ ID NO: 8054), ATPE.SGPGX$_n$ATPE.SGPG (SEQ ID NO:8046), ATPE.SGPGX$_n$GTPE.SGPG (SEQ ID NO: 8054), TTPE.SGPGX$_n$TTPE.SGPG (SEQ ID NO:8073), or STPE.SGPGX$_n$STPE.SGPG (SEQ ID NO: 8085), wherein each "." is a Glu-C cleavage site and n is any integer from 0 to 30.

In some embodiments, n is any integer from 1 to 20. In some embodiments, n is any integer from 5 to 15. In some embodiments, n is any integer from 3 to 7. In some embodiments, n is any integer from 5 to 10. In some embodiments, n is 9. In some embodiments, n is 4.

In some embodiments, X$_n$ is PGTGTSAT (SEQ ID NO:8146), PGSGPGT (SEQ ID NO:8147), PGTTPGTT (SEQ ID NO:8148), PGTPPTST (SEQ ID NO:8149), PGT-SPSAT (SEQ ID NO:8150), PGTGSAGT (SEQ ID NO:8151), PGTGGAGT (SEQ ID NO:8152), PGTSPGAT (SEQ ID NO:8153), PGTSGSGT (SEQ ID NO:8154), PGTSSAST (SEQ ID NO:8155), PGTGAGTT (SEQ ID NO:8156), PGTGSTST (SEQ ID NO:8157), GSEPATSG (SEQ ID NO:8158), APGTSTEP (SEQ ID NO:8159), PGTAGSGT (SEQ ID NO:8160), PGTSSGGT (SEQ ID NO:8161), PGTAGPAT (SEQ ID NO:8162), PGTPGTGT (SEQ ID NO:8163), PGTGGPTT (SEQ ID NO:8164), or PGTGSGST (SEQ ID NO:8165).

In some embodiments, X$_{11}$ is TGTS (SEQ ID NO:8166), SGP. TTPG (SEQ ID NO:8167), TPPT (SEQ ID NO:8168), TSPS (SEQ ID NO:8169), TGSA (SEQ ID NO:8170), TGGA (SEQ ID NO: 8171), TSPG (SEQ ID NO:8172), TSGS (SEQ ID NO:8173), TSSA (SEQ ID NO:8174), TGAG (SEQ ID NO: 8175), TGST (SEQ ID NO:8176), EPAT (SEQ ID NO:8177), GTST (SEQ ID NO:8178), TAGS (SEQ ID NO:8179), TSSG (SEQ ID NO:8180), TAGP (SEQ ID NO:8181), TPGT (SEQ ID NO: 8182), TGGP (SEQ ID NO:8183), or TGSG (SEQ ID NO:8184).

In some embodiments, neither the N-terminal amino acid nor the C-terminal amino acid of the chimeric polypeptide is included in a barcode fragment.

In some embodiments, the chimeric polypeptide comprises an ELNN with a non-overlapping sequence motif that occurs only once within the ELNN, wherein the ELNN further comprises a barcode fragment that includes at least part of the non-overlapping sequence motif that occurs only once within the ELNN.

In some embodiments, the chimeric polypeptide comprises a first ELNN with a first barcode fragment and a second ELNN with a second barcode fragment, wherein neither the first barcode fragment nor the second barcode fragment includes a glutamate that is immediately adjacent to another glutamate, if present, in the ELNN that contains the barcode fragment.

In some embodiments, at least one of the barcode fragments comprises a glutamate at the C-terminus thereof.

In some embodiments, at least one of the barcode fragments has an N-terminal amino acid that is immediately preceded by a glutamate in the chimeric polypeptide.

In some embodiments, the glutamate that precedes the N-terminal amino acid of the barcode fragment is not immediately adjacent to another glutamate.

In some embodiments, at least one of the barcode fragments does not include a second glutamate at a position other than the C-terminus of the barcode fragment unless the second glutamate is immediately followed by a proline.

In some embodiments, the chimeric polypeptide comprises a single polypeptide chain, wherein the chimeric polypeptide comprises a barcode fragment that is at a position within the polypeptide chain that is from 10 to 200 amino acids or from 10 to 125 amino acids from the N-terminus or the C-terminus of the chimeric polypeptide.

In some embodiments, the first ELNN is at the N-terminal side of the bispecific antibody domain, and wherein the first barcode fragment is positioned within 200, 150, 100, or 50 amino acids of the N-terminus of the chimeric polypeptide.

In some embodiments, the second ELNN is at the C-terminal side of the bispecific antibody domain, and wherein the second barcode fragment is positioned within 200, 150, 100, or 50 amino acids of the C-terminus of the chimeric polypeptide.

In some embodiments, at least one of the barcode fragments is at least 4 amino acids in length. In some embodiments, at least one of the barcode fragments is from 4 to 20, from 5 to 15, from 6 to 12, or from 7 to 10 amino acids in length.

In some embodiments, each mask polypeptide comprises one barcode fragment that is listed in Table 2 or disclosed in Table 3a.

In some embodiments, the chimeric polypeptide comprises a barcode fragment comprising an amino acid sequence that has at least 85%, 90%, 91%, 92%, 93%, 94%, 95%, 96%, 97%, 98%, or 99% identity, or 100% identity, to SGPGSGPGTSE (SEQ ID NO:78) or SGPGTSPSATPE (SEQ ID NO:79).

In some embodiments, the chimeric polypeptide comprises one barcode fragment comprising an amino acid sequence that is at least 95% identical to SGPGSGPGTSE (SEQ ID NO:78) and one barcode fragment comprising an amino acid sequence that is at least 95% identical to SGPGTSPSATPE (SEQ ID NO: 79).

In some embodiments, the barcode fragment consists of A, E, G, S, P, and/or T residues.

In some embodiments, the barcode fragment is part of a mask peptide.

In some embodiments, the mask peptide is the first ELNN or the second ELNN.

In one aspect, the disclosure provides a chimeric polypeptide, comprising an amino acid sequence that has at least 85%, 90%, 91%, 92%, 93%, 94%, 95%, 96%, 97%, 98%, or 99% identity, or 100% identity, to:

```
                                    (SEQ ID NO: 1000)
ASSATPESGPGTSTEPSEGSAPGTSESATPESGPGSGPGTSESATPGTSE

SATPESGPGSEPATSGSETPGTSESATPESGPGTSTEPSEGSAPGSPAGS

PTSTEEGTSESATPESGPGSEPATSGSETPGTSESATPESGPGSPAGSPT

STEEGSPAGSPTSTEEGTSTEPSEGSAPGTSESATPESGPGTSESATPES

GPGTSESATPESGPGSEPATSGSETPGSEPATSGSETPGSPAGSPTSTEE

GTSTEPSEGSAPGTSTEPSEGSAPGSEPATSGSETPGTSESATPEAGRSA

SHTPAGLTGPGTSESATPESDIQMTQSPSSLSASVGDRVTITCQASQDIS

NYLNWYQQKPGKAPKLLIYDASNLETGVPSRFSGSGSGTDFTFTISSLQP

EDIATYYCQHFDHLPLAFGQGTKVEIKSESATPESGPGTSPGATPESGPG

TSESATPQVQLQESGPGLVKPSETLSLTCTVSGGSVSSGDYYWTWIRQPP

GKGLEWIGHIYYSGNTNYNPSLKSRVTISVDTSKNQFSLKLSSVTAADTA

VYYCARDRVTGAFDIWGQGTLVTVSSGGGGSELVVTQEPSLTVSPGGTVT

LTCRSSNGAVTSSNYANWVQQKPGQAPRGLIGGTNKRAPGTPARFSGSLL

EGKAALTLSGVQPEDEAVYYCALWYPNLWVFGGGTKLTVLSESATPESGP

GTSPGATPESGPGTSESATPEVQLVESGGGIVQPGGSLRLSCAASGFTFS

TYAMNWVRQAPGKGLEWVGRIRTKRNDYATYYADSVKGRFTISRDDSKNT

LYLQMNSLKTEDTAVYYCVRHENFGNSYVSWFAHWGQGTLVTVSSGTATP

ESGPGEAGRSASHTPAGLTGPATPESGPGTSESATPESGPGSPAGSPTST

EEGTSESATPESGPGSEPATSGSETPGTSESATPESGPGTSTEPSEGSAP

GTSTEPSEGSAPGTSTEPSEGSAPGTSTEPSEGSAPGTSTEPSEGSAPGT

STEPSEGSAPGSPAGSPTSTEEGTSTEPSEGSAPGTSESATPESGPGSEP

ATSGSETPGTSESATPESGPGSEPATSGSETPGTSESATPESGPGTSTEP

SEGSAPGTSESATPESGPGSPAGSPTSTEEGSPAGSPTSTEEGSPAGSPT

STEEGTSESATPESGPGTSTEPSEGSAPGTSESATPESGPGSEPATSGSE

TPGTSESATPESGPGSEPATSGSETPGTSESATPESGPGTSTEPSEGSAP

GSPAGSPTSTEEGTSESATPESGPGSEPATSGSETPGTSESATPESGPGS

PAGSPTSTEEGSPAGSPTSTEEGTSTEPSEGSAPGTSESATPESGPGTSE

SATPESGPGTSPSATPESGPGSEPATSGSETPGSEPATSGSETPGSPAGS

PTSTEEGTSTEPSEGSAPGTSTEPSEGSAPGSEPATSGSETPGTSESAGE

PEA.
```

In some embodiments, the chimeric polypeptide comprises the following amino acid sequence:

```
                                    (SEQ ID NO: 1000)
ASSATPESGPGTSTEPSEGSAPGTSESATPESGPGSGPGTSESATPGTSE

SATPESGPGSEPATSGSETPGTSESATPESGPGTSTEPSEGSAPGSPAGS

PTSTEEGTSESATPESGPGSEPATSGSETPGTSESATPESGPGSPAGSPT
```

-continued
```
STEEGSPAGSPTSTEEGTSTEPSEGSAPGTSESATPESGPGTSESATPES

GPGTSESATPESGPGSEPATSGSETPGSEPATSGSETPGSPAGSPTSTEE

GTSTEPSEGSAPGTSTEPSEGSAPGSEPATSGSETPGTSESATPEAGRSA

SHTPAGLTGPGTSESATPESDIQMTQSPSSLSASVGDRVTITCQASQDIS

NYLNWYQQKPGKAPKLLIYDASNLETGVPSRFSGSGSGTDFTFTISSLQP

EDIATYYCQHFDHLPLAFGQGTKVEIKSESATPESGPGTSPGATPESGPG

TSESATPQVQLQESGPGLVKPSETLSLTCTVSGGSVSSGDYYWTWIRQPP

GKGLEWIGHIYYSGNTNYNPSLKSRVTISVDTSKNQFSLKLSSVTAADTA

VYYCARDRVTGAFDIWGQGTLVTVSSGGGGSELVVTQEPSLTVSPGGTVT

LTCRSSNGAVTSSNYANWVQQKPGQAPRGLIGGTNKRAPGTPARFSGSLL

EGKAALTLSGVQPEDEAVYYCALWYPNLWVFGGGTKLTVLSESATPESGP

GTSPGATPESGPGTSESATPEVQLVESGGGIVQPGGSLRLSCAASGFTFS

TYAMNWVRQAPGKGLEWVGRIRTKRNDYATYYADSVKGRFTISRDDSKNT

LYLQMNSLKTEDTAVYYCVRHENFGNSYVSWFAHWGQGTLVTVSSGTATP

ESGPGEAGRSASHTPAGLTGPATPESGPGTSESATPESGPGSPAGSPTST

EEGTSESATPESGPGSEPATSGSETPGTSESATPESGPGTSTEPSEGSAP

GTSTEPSEGSAPGTSTEPSEGSAPGTSTEPSEGSAPGTSTEPSEGSAPGT

STEPSEGSAPGSPAGSPTSTEEGTSTEPSEGSAPGTSESATPESGPGSEP

ATSGSETPGTSESATPESGPGSEPATSGSETPGTSESATPESGPGTSTEP

SEGSAPGTSESATPESGPGSPAGSPTSTEEGSPAGSPTSTEEGSPAGSPT

STEEGTSESATPESGPGTSTEPSEGSAPGTSESATPESGPGSEPATSGSE

TPGTSESATPESGPGSEPATSGSETPGTSESATPESGPGTSTEPSEGSAP

GSPAGSPTSTEEGTSESATPESGPGSEPATSGSETPGTSESATPESGPGS

PAGSPTSTEEGSPAGSPTSTEEGTSTEPSEGSAPGTSESATPESGPGTSE

SATPESGPGTSPSATPESGPGSEPATSGSETPGSEPATSGSETPGSPAGS

PTSTEEGTSTEPSEGSAPGTSTEPSEGSAPGSEPATSGSETPGTSESAGE

PEA.
```

In one aspect, the disclosure provides a pharmaceutical composition comprising the chimeric polypeptide described herein and at least one pharmaceutically acceptable excipient. In some embodiments, the pharmaceutical composition is in a liquid form or is frozen. In some embodiments, the pharmaceutical composition is formulated as a lyophilized powder or cake to be reconstituted prior to administration.

In one aspect, the disclosure provides an injection device comprising the pharmaceutical composition described herein. In some embodiments, injection device comprises a syringe.

In one aspect, the disclosure provides a polynucleotide sequence encoding the chimeric polypeptide described herein.

In one aspect, the disclosure provides an expression vector comprising the polynucleotide sequence encoding the chimeric polypeptide described herein.

In one aspect, the disclosure provides a host cell comprising the expression vector comprising the polynucleotide sequence encoding the chimeric polypeptide described herein.

In one aspect, the disclosure provides a method of producing the chimeric polypeptide described herein. In some embodiments, the method further comprises isolating the chimeric polypeptide from a host cell.

In one aspect, the disclosure provides a method of treating cancer in a subject in need thereof, the method comprising administering an effective amount of the chimeric polypeptide described herein to the subject.

In some embodiments, the cancer comprises a solid tumor.

In some embodiments, the cancer is a carcinoma, a sarcoma, or a melanoma.

In some embodiments, the cancer expresses EGFR.

In some embodiments, the cancer overexpresses EGFR.

In some embodiments, the cancer comprises cells that express, on average, at least 3,000; 5,000; 10,000; 20,000; 30,000; 40,000; 50,000; 60,000; 70,000; 80,000; 90,000; 100,000; or 200,000EGFR proteins per cell.

In some embodiments, the cancer comprises cells having one or more oncogenic mutations in an EGFR gene.

In some embodiments, the cancer comprises cells having an EGFR gene amplification.

In some embodiments, the cells comprise a 2 to 5-fold, 2 to 10-fold, 2 to 15-fold, 2 to 30-fold, 2 to 50-fold, 3 to 5-fold, 3 to 10-fold, 3 to 15-fold, 3 to 30-fold, 3 to 50-fold, 5 to 10-fold, 5 to 15-fold, 5 to 30-fold, or 5 to 50-fold increase in EGFR gene copy number as compared to a non-cancerous cell of the same tissue type.

In some embodiments, the cancer is lung cancer, colorectal cancer, head and neck cancer, breast cancer, pancreatic cancer, brain cancer, liver cancer, kidney cancer, ovarian cancer, prostate cancer, esophageal cancer, cervical cancer, or bladder cancer.

In some embodiments, the cancer is lung cancer.

In some embodiments, the lung cancer is non-small cell lung cancer.

In some embodiments, the cancer is colorectal cancer.

In some embodiments, the cancer is head and neck squamous cell carcinoma.

In some embodiments, the cancer is breast cancer.

In some embodiments, the cancer is triple-negative breast cancer.

In some embodiments, the cancer is brain cancer.

In some embodiments, the brain cancer is glioblastoma.

In some embodiments, the method further comprises administering a checkpoint inhibitor to the subject.

In some embodiments, the checkpoint inhibitor is a PD-1 inhibitor, a PD-L1 inhibitor, or a CTLA-4 inhibitor.

In some embodiments, the checkpoint inhibitor is an anti-PD-1 antibody or an anti-PD-L1 antibody.

In some embodiments, the checkpoint inhibitor is pembrolizumab or cemiplimab.

In one aspect, the disclosure provides an antibody or an antigen-binding fragment thereof that specifically binds EGFR, comprising: a VH domain comprising a CDR1 amino acid sequence of GGSVSSGDYYWT (SEQ ID NO: 562), a CDR2 amino acid sequence of HIYYSGNTNYNPSLKS (SEQ ID NO: 563), and a CDR3 amino acid sequence of DRVTGAFDI (SEQ ID NO: 564); and at least one of: a proline (P) residue at position 40 in FR2, a valine (V) residue at position in position 67 in FR3, a valine (V) residue at position 71 in FR3, an asparagine (N) residue at position 76 in FR3, a valine (V) residue at position 89 in FR3, an alanine (A) residue at position 93 in FR3, and/or a leucine (L) residue at position 108 in FR4, wherein the FR numbering is according to Kabat; and a VL domain comprising a CDR1 amino acid sequence of QASQDIS-NYLN (SEQ ID NO: 565), a CDR2 amino acid sequence of DASNLET (SEQ ID NO: 566), a CDR3 amino acid sequence of QHFDHLPLA (SEQ ID NO: 567).

In some embodiments, the VH domain comprises an asparagine (N) residue at position 76 in FR3. In some embodiments, the VH domain comprises alanine (A) residue at position 93 in FR3. In some embodiments, the VH domain comprises a valine (V) residue at position in position 67 in FR3, a valine (V) residue at position 71 in FR3, an asparagine (N) residue at position 76 in FR3, a valine (V) residue at position 89 in FR3, and an alanine (A) residue at position 93 in FR3. In some embodiments, the VH domain comprises a proline (P) residue at position 40 in FR2, a valine (V) residue at position in position 67 in FR3, a valine (V) residue at position 71 in FR3, an asparagine (N) residue at position 76 in FR3, a valine (V) residue at position 89 in FR3, an alanine (A) residue at position 93 in FR3, and a leucine (L) residue at position 108 in FR4.

In some embodiments, the VL domain comprises at least one of: a tyrosine (Y) residue at position 87 in FR3 and/or a glutamine (Q) residue at position 100 in FR4, wherein the FR numbering is according to Kabat. In some embodiments, the VL domain comprises a tyrosine (Y) residue at position 87 in FR3 and a glutamine (Q) residue at position 100 in FR4.

In some embodiments, antibody or an antigen-binding fragment comprises a VH domain comprising an amino acid sequence that has at least 85%, 90%, 91%, 92%, 93%, 94%, 95%, 96%, 97%, 98%, or 99% identity, or 100% identity, to SEQ ID NO: 576; and a VL domain comprising an amino acid sequence that has at least 85%, 90%, 91%, 92%, 93%, 94%, 95%, 96%, 97%, 98%, or 99% identity, or 100% identity, to SEQ ID NO: 577.

In some embodiments, the antibody comprises: i) a VH domain comprising an amino acid sequence of SEQ ID NO: 468 and a VL domain comprising an amino acid sequence of SEQ ID NO: 469; ii) a VH domain comprising an amino acid sequence of SEQ ID NO: 466 and a VL domain comprising an amino acid sequence of SEQ ID NO: 467; iii) a VH domain comprising an amino acid sequence of SEQ ID NO: 490 and a VL domain comprising an amino acid sequence of SEQ ID NO: 491; iv) a VH domain comprising an amino acid sequence of SEQ ID NO: 492 and a VL domain comprising an amino acid sequence of SEQ ID NO: 493; v) a VH domain comprising an amino acid sequence of SEQ ID NO: 514 and a VL domain comprising an amino acid sequence of SEQ ID NO: 515; vi) a VH domain comprising an amino acid sequence of SEQ ID NO: 516 and a VL domain comprising an amino acid sequence of SEQ ID NO: 517; vii) a VH domain comprising an amino acid sequence of SEQ ID NO: 538 and a VL domain comprising an amino acid sequence of SEQ ID NO: 539; or viii) a VH domain comprising an amino acid sequence of SEQ ID NO: 540 and a VL domain comprising an amino acid sequence of SEQ ID NO: 541.

In one aspect, the disclosure provides an anti-CD3 antibody or an antigen-binding fragment thereof, comprising the following CDRs: a VH domain comprising a CDR1 amino acid sequence of GFTFSTYAMN (SEQ ID NO: 12), a CDR2 amino acid sequence of RIRTKRNDYATYY-ADSVKG (SEQ ID NO: 14), and a CDR3 amino acid sequence of HENFGNSYVSWFAH (SEQ ID NO: 10); and a VL domain comprising a CDR1 amino acid sequence of RSSNGAVTSSNYAN (SEQ ID NO: 1), a CDR2 amino acid sequence of GTNKRAP (SEQ ID NO: 4), and a CDR3 amino acid sequence of ALWYPNLWV (SEQ ID NO: 6).

In some embodiments, the VL domain comprises the amino acid sequence of ELVVTQEPSLTVSPGGTVTLT- CRSSNGAVTSSNYANWVQQKPGQAPRGLIGGTNK-
RAPGTPARF      SGSLLEGKAALTLSGVQPEDEAVYY-
CALWYPNLWVFGGGTKLTVL (SEQ ID NO: 127); and
the VH domain comprises the amino acid sequence of (SEQ ID NO: 126)
EVQLVESGGGIVQPGGSLRLSCAASGFTFSTYAMNWVRQAPGKGLEWVGR

IRTKRNDYATYYADSVKGRFTISRDDSKNTLYLQMNSLKTEDTAVYYCVR

HENFGNSYVSWFAHWGQGTLVTVSS.

Various features of this disclosure are set forth with particularity in the appended claims. A better understanding of the features and advantages of the present disclosure will be obtained by reference to the following detailed description that sets forth illustrative embodiments, in which the principles of the invention are utilized, and the accompanying drawings.

BRIEF DESCRIPTION OF THE DRAWINGS

FIG. 3 depicts a schematic representation of fully unmasked paTCE (a uTCE) and singly masked metabolites paTCE (1x-N) and paTCE (1x-C) from an exemplary paTCE as shown in FIG. 1.

FIG. 4 depicts a schematic representation of an antibody framework screen. To identify anti-EGFR antigen-binding fragments with improved properties, the CDRs of a donor anti-EGFR antibody, panitumumab, were grafted in a combinatorial manner into the framework regions from approved monoclonal antibody therapies. A paTCE library having the anti-EGFR antigen-binding fragments was screened for stability, expression, and binding.

FIG. 5D depicts a simulated ribbon structure of an anti-EGFR antibody fragment associated with EGFR.

FIG. 8A and FIG. 8B depict relative plasma stability of paTCEs employing RSR-2295 or RSR-3213, measured at Day 0 and Day 7. In FIG. 8A. RSR-2295 employed the SCy5.5 fluorophore and RSR-3213 employed the Scy7.5 fluorophore. In FIG. 8B, the RSR-2295 employed the Scy7.5 fluorophore and RSR-3213 employed the Scy5.5 fluorophore.

FIG. 10A-FIG. 10C depicts cytotoxicity curves for exemplary donor cells HT-29 (FIG. 10A), MDA-MB-231 (FIG. 10B), and A-431 (FIG. 10C)

FIG. 16 depicts immunohistochemistry (IHC) images and corresponding quantification of CD8$^+$ T cells in tumor tissue from a LoVo xenograft mouse model.

FIG. 17 depicts IHC images and corresponding quantification of CD4$^+$ T cells in tumor tissue from a LoVo xenograft mouse model.

DETAILED DESCRIPTION

Figure 1:
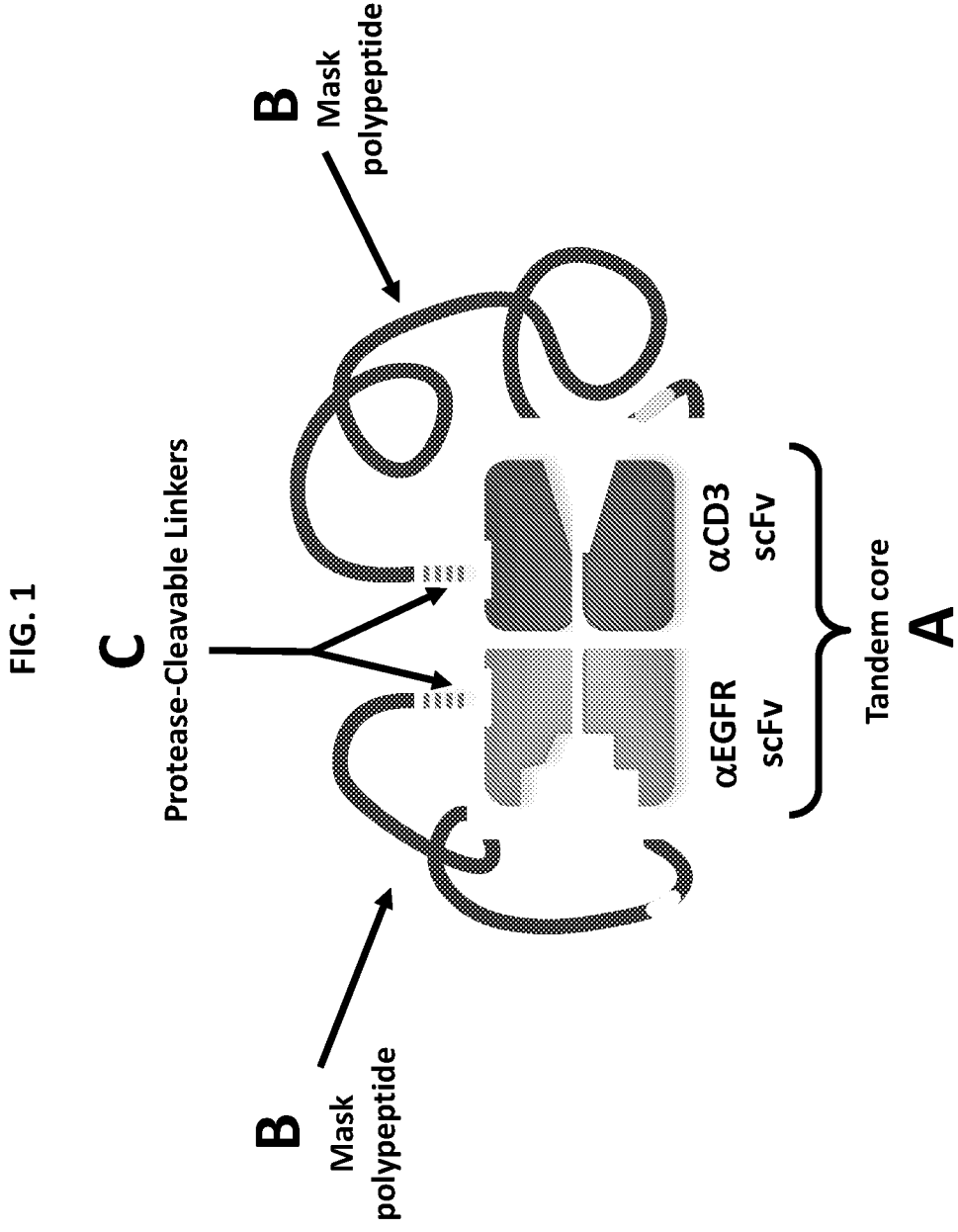
FIG. 1 depicts a schematic representation of an exemplary EGFR-targeted paTCE.
Figure 2:
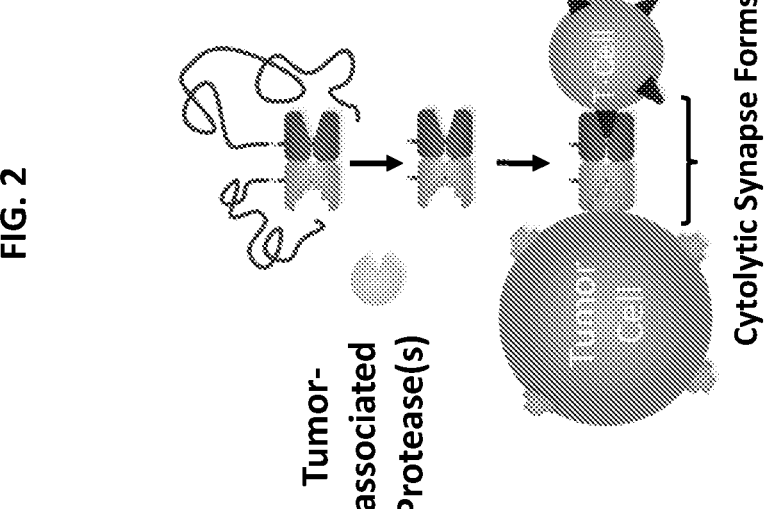
FIG. 2 depicts a schematic representation of a proposed mechanism of action of the exemplary paTCEs of the disclosure.

There is a significant unmet need in cancer therapeutics for an EGFR-targeted bispecific treatment modality that is efficacious against solid tumors, particularly solid tumors that are present in an immunologically cold microenvironment. While TCEs have been shown to be effective in inducing remission in certain cancers, they have not led to the development of widespread therapeutics due to their extreme potency and on target, off tumor toxicities in healthy tissues.

Without being bound by any scientific theory. TCEs form a bridge between T cells and tumor cells and activate T cell-mediated killing of the tumor cells and further initiating a cytokine amplification cascade. The cytokine amplification cascade can promote further killing of tumor cells and potentially provide long term immunity. T cells activated by TCEs release cytolytic perforin/granzymes in a manner that is independent of antigen-MHC recognition. This creates a two-fold response: direct tumor cell death and amplification of tumor killing through initiation of a powerful cytokine response from the tumor cells. The direct tumor cell death results in release of tumor antigens. The cytokine response may include, among others, increased interferon-γ which stimulates CD8 T cell activity and stimulates antigen presentation by APCs; increased IL2 which causes increased proliferation of activated T-cells, and increased CXCL9 and 10 response which increases T cell recruitment. Together the release of tumor antigens and the initiation of the cytokine response results in activation of the endogenous T cell response which potentially causes epitope spreading to induce long term immunity.

One toxicity challenge with TCEs arises out the fact that many tumor targets are, to some extent, also expressed in healthy tissue, and normal cells also can produce the cytokines response resulting in cytokine release syndrome (CRS). These two powerful responses of health tissue to T cell activation by TCEs often results in an overall lack of acceptable therapeutic index for these agents.

The present disclosure provides protease-activatable TCEs (paTCEs) that address an unmet need and are superior in one or more aspects including enhanced terminal half-life, improved stability, targeted delivery, and/or improved therapeutic ratio with reduced toxicity to healthy tissues compared to conventional antibody therapeutics or bispecific antibody therapeutics that are active upon injection.

Included herein are compounds, compositions and methods that overcome the drawbacks in the existing TCEs by providing paTCEs that target EGFR (referred to herein as EGFR-paTCEs and exemplified as AMX-525).

AMX-525 comprises the amino acid sequence set forth as SEQ ID NO: 1000. Without being bound by any scientific theory, the paTCEs described herein are understood to exploit the dysregulated protease activity present in tumors vs. healthy tissues, enabling expansion of the therapeutic index. The paTCE core comprises antigen binding domains; one targets CD3 and the other targets EGFR. The two antigen-binding domains may, in exemplary embodiments, be in two different antibody formats (such as, e.g., a single chain antibody fragment (scFv) and a VHH), or the same antibody format (such as, e.g., scFvs). Many different antibody fragments or formats may be used.

In some embodiments, an EGFR-targeting paTCE comprises a first portion that is an scFv that binds to EGFR and a second portion that is an scFv that binds to CD3. One or more (e.g., two) unstructured polypeptide masks are attached to the core. In some embodiments, these unstructured polypeptide masks sterically reduce target engagement of either the tumor target and/or CD3, and also extend protein half-life. In some embodiments, the unstructured polypeptide masks are extended length non-natural polypeptides (ELNNs).

In some embodiments, the properties of ELNNs also minimize the potential for immunogenicity, as their lack of stable tertiary structures disfavors antibody binding, and the absence of hydrophobic, aromatic, and positively charged residues that serve as anchor residues for peptide MHC II binding reduces the potential for T cell epitopes.

In some embodiments, protease cleavage sites at the base of the ELNN or ELNNs enable proteolytic activation of paTCEs in the tumor microenvironment, unleashing a smaller, highly potent TCEs that are capable redirecting cytotoxic T cells to kill target-expressing tumor cells. In some embodiments, in healthy tissues, where protease activity is tightly regulated, paTCEs remain predominantly inactive, thus expanding the therapeutic index compared to unmasked TCEs.

In some embodiments, in addition to localized activation, the short half-life of the unmasked TCE form further widens the therapeutic index while providing the potency of T-cell immunity to improve the eradication of solid tumors. In some embodiments, the release sites used in the paTCEs can be cleaved across a broad array of tumors by proteases that are collectively involved in every cancer hallmark (growth; survival and death; angiogenesis; invasion and metastasis; inflammation; and immune evasion). Thus, TCE activity of the paTCEs is localized to tumors by exploiting the enhanced protease activity that is upregulated in all stages of cancer and tumor development but is tightly regulated in healthy tissues.

Terminology

As used herein, the following terms have the meanings ascribed to them unless specified otherwise.

As used in the specification and claims, the singular forms "a," "an," and "the" include plural references unless the context clearly dictates otherwise. For example, the term "a cell" includes a plurality of cells, including mixtures thereof, unless the context clearly dictates otherwise.

Furthermore, "and/or" where used herein is to be taken as specific disclosure of each of the two specified features or components with or without the other. Thus, the term "and/or" as used in a phrase such as "A and/or B" herein is intended to include "A and B." "A or B." "A" (alone), and "B" (alone). Likewise, the term "and/or" as used in a phrase such as "A, B, and/or C" is intended to encompass each of the following aspects: "A, B, and C"; "A, B, or C"; "A or C"; "A or B"; "B or C"; "A and C"; "A and B"; "B and C"; "A" (alone); "B" (alone); and "C" (alone).

It is understood that wherever aspects are described herein with the language "comprising." otherwise analogous aspects described in terms of "consisting of" and/or "consisting essentially of" are also provided.

Numeric ranges are inclusive of the numbers defining the range. Unless otherwise indicated, amino acid sequences are written left to right in amino to carboxy orientation. The headings provided herein are not limitations of the various aspects of the disclosure. Accordingly, the terms defined immediately below are more fully defined by reference to the specification in its entirety.

The term "about" is used herein to mean approximately, roughly, around, or in the regions of. When the term "about" is used in conjunction with a numerical range, it modifies that range by extending the boundaries above and below the numerical values set forth. In general, the term "about" can modify a numerical value above and below the stated value by a variance of, e.g., 10 percent, up or down (higher or lower). In some embodiments, the term indicates deviation from the indicated numerical value by ±10%, ±5%, ±4%, ±3%, ±2%, ±1%, ±0.9%, ±0.8%, ±0.7%, ±0.6%, ±0.5%, ±0.4%, ±0.3%, ±0.2%, ±0.1%, ±0.05%, or ±0.01%. In some embodiments, "about" indicates deviation from the indicated numerical value by ±10%. In some embodiments, "about" indicates deviation from the indicated numerical value by ±5%. In some embodiments, "about" indicates deviation from the indicated numerical value by ±4%. In some embodiments, "about" indicates deviation from the indicated numerical value by ±3%. In some embodiments, "about" indicates deviation from the indicated numerical value by ±2%. In some embodiments, "about" indicates deviation from the indicated numerical value by ±1%. In some embodiments, "about" indicates deviation from the indicated numerical value by ±0.9%. In some embodiments, "about" indicates deviation from the indicated numerical value by ±0.8%. In some embodiments, "about" indicates deviation from the indicated numerical value by ±0.7%. In some embodiments, "about" indicates deviation from the indicated numerical value by ±0.6%. In some embodiments, "about" indicates deviation from the indicated numerical value by ±0.5%. In some embodiments, "about" indicates deviation from the indicated numerical value by ±0.4%. In some embodiments, "about" indicates deviation from the indicated numerical value by ±0.3%. In some embodiments, "about" indicates deviation from the indicated numerical value by ±0.1%. In some embodiments, "about" indicates deviation from the indicated numerical value by ±0.05%. In some embodiments, "about" indicates deviation from the indicated numerical value by ±0.01%.

With respect to naturally occurring compounds, the term "isolated" refers to a compound (i.e., a polypeptide or polynucleotide) that is not in its native state (e.g., free to varying degrees from components that naturally accompany the compound in nature). No particular level of purification is required. For example, an isolated polypeptide can simply be removed from its native or natural environment. Recombinantly produced polypeptides and proteins expressed in host cells are considered isolated for the purpose of the disclosure, as are native or recombinant polypeptides which have been separated, fractionated, or partially or substantially purified by any suitable technique. "Isolate" and "isolated" may also denote a degree of separation from an original source or surrounding, depending on context.

The term "polypeptide" refers to any polymer of two or more amino acids. Thus, the terms peptide, dipeptide, tripeptide, oligopeptide, protein, amino acid chain, or any other term used to refer to a chain of two or more amino acids, is included within the definition of "polypeptide." The term "polypeptide" also encompasses an amino acid polymer that has been modified (e.g., by post-translational modification), for example, by disulfide bond formation, glycosylation, lipidation, acetylation, phosphorylation, or any other manipulation, such as conjugation with a labeling component. Depending on context, the term "polypeptide" may also be used to refer to a protein comprising two or more polymers of two or more amino acids.

A "host cell" includes an individual cell (e.g., in culture) which that comprises an exogenous polynucleotide. Host cells may include progeny of a single host cell. The progeny may not necessarily be completely identical (in morphology or in genomic of total DNA complement) to the original parent cell due to naturally occurring or genetically engineered variation.

A "fusion" or "chimeric" polypeptide or protein comprises a first polypeptide portion linked to a second polypeptide portion with which it is not naturally linked in nature. In some embodiments, the portions may normally exist in separate proteins and are brought together in the fusion polypeptide; they may normally exist in the same protein but are placed in a new arrangement in the fusion polypeptide; or the portions may be brought together from different sources. In some embodiments, a fusion or chimeric protein comprises two or more moieties that do not occur in nature (e.g., are created, designed, or otherwise generated by humans, such as binding domains, masks, linkers, barcodes, and other polypeptides provided herein). A chimeric protein may be created, for example, by chemical synthesis, or by recombinant expression (e.g., comprising creating and translating a polynucleotide in which the peptide regions are encoded in the desired relationship).

"Conjugated", "linked." "fused." and "fusion" may be used interchangeably herein, depending on context. These terms may refer to the covalent joining together of two more chemical (e.g., polypeptide) elements or components, by whatever means including chemical conjugation or recombinant means.

As known in the art, "sequence identity" between two polypeptides is determined by comparing the amino acid sequence of one polypeptide to the sequence of a second polypeptide. Similarly, "sequence identity" between two polynucleotides is determined by comparing the nucleotide sequence of one polynucleotide to the sequence of a second polynucleotide. The terms "% identical", "% identity" or similar terms are intended to refer, in particular, to the percentage of nucleotides or amino acids (as applicable) which are identical in an optimal alignment between the sequences to be compared. Said percentage may be purely statistical, and the differences between the two sequences may be but are not necessarily randomly distributed over the entire length of the sequences to be compared. Comparisons of two sequences are usually carried out by comparing the sequences, after optimal alignment, with respect to a segment or "window of comparison", in order to identify local regions of corresponding sequences. For example, the optimal alignment for a comparison may be carried out manually or with the aid of the local homology algorithm by Smith and Waterman, 1981, Ads App. Math. 2, 482, with the aid of the local homology algorithm by Neddleman and Wunsch, 1970, J. Mol. Biol. 48, 443, with the aid of the similarity search algorithm by Pearson and Lipman, 1988, Proc. Natl Acad. Sci. USA 88, 2444, or with the aid of computer programs using the algorithms (GAP, BESTFIT, FASTA, BLAST P, BLAST N and TFASTA in Wisconsin Genetics Software Package, Genetics Computer Group, 575 Science Drive, Madison, Wis.). In some embodiments, percent identity of two sequences is determined using the BLASTN or BLASTP algorithm, as available on the United States National Center for Biotechnology Information (NCBI) website. In some embodiments, the algorithm parameters used for BLASTN algorithm on the NCBI website include: (i) Expect Threshold set to 10; (ii) Word Size set to 28; (iii) Max matches in a query range set to 0; (iv) Match/Mismatch Scores set to 1, −2; (v) Gap Costs set to Linear; and (vi) the filter for low complexity regions being used. In some embodiments, the algorithm parameters used for BLASTP algorithm on the NCBI website include: (i) Expect Threshold set to 10; (ii) Word Size set to 3; (iii) Max matches in a query range set to 0; (iv) Matrix set to BLOSUM62; (v) Gap Costs set to Existence: 11 Extension: 1; and (vi) conditional compositional score matrix adjustment. When discussed herein, whether any particular polypeptide is at least about 50%, 60%, 70%, 75%, 80%, 85%, 90%, 95%, 99%, or 100% identical to another polypeptide can be determined using methods and computer programs/ software known in the art such as, but not limited to, the BESTFIT program (Wisconsin Sequence Analysis Package, Version 8 for Unix, Genetics Computer Group, University Research Park, 575 Science Drive, Madison, WI 53711). BESTFIT uses the local homology algorithm of Smith and Waterman, Advances in Applied Mathematics 2:482-489 (1981), to find the best segment of homology between two sequences. When using BESTFIT or any other sequence alignment program to determine whether a particular sequence is, for example, 95% identical to a reference sequence according to the present disclosure, the parameters are set, of course, such that the percentage of identity is calculated over the full-length of the reference polypeptide sequence and that gaps in homology of up to 5% of the total number of amino acids in the reference sequence are allowed.

As used herein, the terms "mask polypeptide", "mask", and "masking moiety" refer to a polypeptide that is capable of reducing the binding of an antigen binding domain (e.g., an antibody) to the target antigen in the context of a fusion protein (such as a chimeric polypeptide) provided herein. Exemplary mask polypeptides include, but are not limited to, the ELNN polypeptides described herein. Additional mask polypeptides include albumin, polypeptides consisting of proline, serine and alanine, coiled-coil domains, albumin binding domains, Fc domains, and binding domains with specificity to conserved regions of an antibody variable domain. Mask polypeptides are described in further detail in Lucchi et al. (ACS Cent Sci. 2021 May 26; 7 (5): 724-738).

As used herein, the terms "ELNN polypeptides" and "ELNNs" are synonymous and refer to extended length polypeptides comprising non-naturally occurring, substantially non-repetitive sequences (e.g., polypeptide motifs) that are composed mainly of small hydrophilic amino acids, with the sequence having a low degree or no secondary or tertiary structure under physiologic conditions. ELNN polypeptides include unstructured hydrophilic polypeptides comprising repeating motifs of 6 natural amino acids (G, A. P. E. S, and/or T). In some embodiments, an ELNN polypeptide comprises multiple motifs of 6 natural amino acids (G, A. P. E. S. T), wherein the motifs are the same or comprise a combination of different motifs. In some embodiments, ELNN polypeptides can confer certain desirable pharmacokinetic, physicochemical, and pharmaceutical properties when linked to proteins, including T-cell engagers as disclosed herein. Such desirable properties may include but are not limited to enhanced pharmacokinetic parameters and solubility characteristics, as well as improved therapeutic index. ELNN polypeptides are known in the art, and non-limiting descriptions relating to and examples of ELNN polypeptides known as XTEN® polypeptides are available in Schellenberger et al., (2009) *Nat Biotechnol* 27 (12): 1186-90; Brandl et al., (2020) *Journal of Controlled Release* 327:186-197; and Radon et al., (2021) *Advanced Functional Materials* 31, 2101633 (pages 1-33), the entire contents of each of which are incorporated herein by reference.

In some embodiments, the repetitiveness of an ELNN sequence refers to the 3-mer repetitiveness and can be measured by computer programs or algorithms or by other means known in the art. In some embodiments, the 3-mer repetitiveness of an ELNN may be assessed by determining the number of occurrences of the overlapping 3-mer sequences within the polypeptide. For example, a polypeptide of 200 amino acid residues has 198 overlapping 3-amino acid sequences (3-mers), but the number of unique 3-mer sequences will depend on the amount of repetitiveness within the sequence. In some embodiments, the score can be generated (hereinafter "subsequence score") that is reflective of the degree of repetitiveness of the 3-mers in the overall polypeptide sequence. In this context, "subsequence score" means the sum of occurrences of each unique 3-mer frame across a 200 consecutive amino acid sequence of the polypeptide divided by the absolute number of unique 3-mer subsequences within the 200 amino acid sequence. Examples of such subsequence scores derived from the first 200 amino acids of repetitive and non-repetitive polypeptides are presented in Example 73 of International Patent Application Publication No. WO 2010/091122 A1, which is incorporated by reference in its entirety.

In some embodiments, and in the context of ELNNs, a "substantially non-repetitive sequence," refers to an ELNN sequence, wherein (1) there are few or no instances of four identical amino acids in a row in the ELNN sequence and wherein (2) the ELNN has a subsequence score (defined in the preceding paragraph herein) of 12, or 10 or less or that there is not a pattern in the order, from N- to C-terminus, of the sequence motifs that constitute the polypeptide sequence.

The term "single chain variable fragment" (scFV) corresponds to an antigen binding domain composed of at least one heavy chain variable domain (VH) linked to at least one light chain variable domain (VL). The VH and VL may be linked with any art recognized linker, including, but not limited to, SESATPESGPGTSPGATPESGPGTSESATP (SEQ ID NO:81). In some embodiments, the scFV comprises, from N-terminus to C-terminus, a VH domain and a VL domain. In other embodiments, the scFv comprises, from N-terminus to C-terminus, a VL domain and a VH domain. Tandem scFvs, such as divalent scFvs (di-scFvs), are scFvs including multiple scFvs linked in tandem. Di-scFvs include two VH and two VL domains, each scFvs having either the same or differing (e.g., bispecific) target specificity. In some embodiments, an scFv described herein is a monovalent scFv or a divalent scFv.

The term "immunoglobulin single variable domain" (ISVD), defines immunoglobulin molecules wherein the antigen binding site is present on, and formed by, a single immunoglobulin domain. This sets immunoglobulin single variable domains apart from "conventional" immunoglobulins (e.g. monoclonal antibodies) or their fragments (such as Fab, Fab', F(ab')2, scFv, di-scFv), wherein two immunoglobulin domains, in particular two variable domains, interact to form an antigen binding site. Typically, in conventional immunoglobulins, a heavy chain variable domain (VH) and a light chain variable domain (VL) interact to form an antigen binding site. In this case, the complementarity determining regions (CDRs) of both VH and VL will contribute to the antigen binding site, i.e. a total of 6 CDRs will be involved in antigen binding site formation, whereas in an ISVD only 3 CDRs from a single domain are contributing to the antigen binding site formation.

In view of the above definition, the antigen-binding domain of a conventional 4-chain antibody (such as an IgG, IgM, IgA, IgD or IgE molecule; known in the art) or of a Fab fragment, a F(ab')2 fragment, an Fv fragment such as a disulphide linked Fv or a scFv fragment, or a diabody (all known in the art) derived from such conventional 4-chain antibody, would normally not be regarded as an immunoglobulin single variable domain, as, in these cases, binding to the respective epitope of an antigen would normally not occur by one (single) immunoglobulin domain but by a pair of (associating) immunoglobulin domains such as light and heavy chain variable domains, i.e., by a VH-VL pair of immunoglobulin domains, which jointly bind to an epitope of the respective antigen.

In contrast, immunoglobulin single variable domains are capable of specifically binding to an epitope of the antigen without pairing with an additional immunoglobulin variable domain. The binding site of an immunoglobulin single variable domain is formed by a single VH, a single VHH or single VL domain.

As such, the single variable domain may be a light chain variable domain sequence (e.g., a VL-sequence) or a suitable fragment thereof; or a heavy chain variable domain sequence (e.g., a VH-sequence or VHH sequence) or a suitable fragment thereof; as long as it is capable of forming a single antigen binding unit (i.e., a functional antigen binding unit that essentially consists of the single variable domain, such that the single antigen binding domain does not need to interact with another variable domain to form a functional antigen binding unit).

An immunoglobulin single variable domain (ISVD) can for example be a heavy chain ISVD, such as a VH, VHH, including a camelized VH or humanized VHH. In some embodiments, it is a VHH, including a camelized VH or humanized VHH. Heavy chain ISVDs can be derived from a conventional four-chain antibody or from a heavy chain antibody.

For example, the immunoglobulin single variable domain may be a single domain antibody (or an amino acid sequence that is suitable for use as a single domain antibody), a "dAb" or dAb (or an amino acid sequence that is suitable for use as a dAb); other single variable domains, or any suitable fragment of any one thereof.

In some embodiments, the immunoglobulin single variable domain may be a NANOBODY® molecule or a suitable antigen-binding fragment thereof. NANOBODY® is a registered trademark of Ablynx N.V.

"VHH domains", also known as VHHs, VHH regions, VHH antibody fragments, and VHH antibodies, have originally been described as the antigen binding immunoglobulin variable domain of "heavy chain antibodies" (i.e., of "antibodies devoid of light chains"; Hamers-Casterman et al. Nature 363:446-448, 1993). The term "VHH domain" has been chosen in order to distinguish these variable domains from the heavy chain variable domains that are present in conventional 4-chain antibodies (which are referred to herein as "VH domains," "VH regions", and "VHs") and from the light chain variable domains that are present in conventional 4-chain antibodies (which are referred to herein as "VL domains", "VL regions", and "VLs"). For a further description of VHHs, reference is made to the review article by Muyldermans (Reviews in Molecular Biotechnology 74:277-302, 2001).

A "vector" is a nucleic acid molecule that transfers an inserted nucleic acid molecule into and/or between host cells. In some embodiments, a vector self-replicates in an appropriate host. The term includes vectors that function primarily for insertion of DNA or RNA into a cell, replication of vectors that function primarily for the replication of DNA or RNA, and expression vectors that function for transcription and/or translation of the DNA or RNA. Also included are vectors that provide more than one of the above functions. An "expression vector" is a polynucleotide which, when introduced into an appropriate host cell, can be used for the transcription of mRNA that is translated into a polypeptide(s). In some embodiments, an "expression system" is a suitable host cell comprising an expression vector that can function to yield a desired expression product.

The terms "treatment" or "treating." and "ameliorating" may be used interchangeably herein. These terms refer to an approach for obtaining beneficial or desired results including but not limited to a therapeutic benefit. By "therapeutic benefit" is meant eradication or amelioration of the underlying disorder being treated. In some embodiments, a therapeutic benefit is achieved with the eradication or amelioration of one or more of the physiological symptoms associated with the underlying disease condition such that an improvement is observed in the subject, notwithstanding that the subject may still be afflicted with the underlying disorder. In some embodiments, a therapeutic benefit comprises slowing or halting the growth of one or more tumors. In some embodiments, a therapeutic benefit comprises reducing the size of one or more tumors. In some embodiments, a therapeutic benefit comprises eradicating one or more tumors from a subject. In some embodiments, a therapeutic benefit comprises effecting the death of cancer cells.

As used herein, the term "therapeutically effective amount" refers to an amount of a biologically active agent (such as a fusion protein provided herein, e.g., as part of a pharmaceutical composition), that is capable of having any detectable, beneficial effect on any symptom, aspect, measured parameter or characteristics of a disease state or condition when administered in one or repeated doses to a subject. Such effect need not be absolute to be beneficial. The disease condition can refer to a disorder or a disease, e.g., cancer or a symptom of cancer.

Antigen Binding Domains, Cleavage Sequences, Barcode Fragments, and Fusion Polypeptides The present disclosure provides, inter alia, new and useful anti-EGFR antibodies, new and useful anti-CD3 antibodies, cleavage sequences, barcode fragments, and fusion proteins comprising the same. Included herein are fusion polypeptides comprising (i) one or more mask polypeptides (such as ELNNs), (ii) a bispecific antibody (BsAb, e.g., a TCE) linked to the mask polypeptide(s), and (iii) one or more protease-cleavable release segments (RS), wherein an RS is positioned between the mask polypeptide(s) and the BsAb.

In some embodiments, anti-EGFR antibodies provided herein include a VH domain comprising the sequence: QVQLQESGPGLVKP-SETLSLTCTVSGGSVSSGDYYWTWIRQPPGK-GLEWIGHIYYSGNTNYNPSL KSRVTISVDTSKNQFSLKLSSVTAADTAVYY-CARDRVTGAFDIWGQGTLVTVSS (SEQ ID NO: 468), and a VL domain comprising the sequence:

```
                                    (SEQ ID NO: 469)
DIQMTQSPSSLSASVGDRVTITCQASQDISNYLNWYQQKPGKAPKLLIYD

ASNLETGVPSRFSGSGSGTDFTFTISSLQPEDIATYYCQHFDHLPLAFGQ

GTKVEIK.
```

In some embodiments, anti-CD3 antibodies provided herein comprise a VH domain comprising the CDRs of a VH domain comprising the sequence:

```
                                    (SEQ ID NO: 126)
EVQLVESGGGIVQPGGSLRLSCAASGFTFSTYAMNWVRQAPGKGLEWVGR

IRTKRNDYATYYADSVKGRFTISRDDSKNTLYLQMNSLKTEDTAVYYCVR

HENFGNSYVSWFAHWGQGTLVTVSS
``` and/or a VL domain comprising the CDRs of a VL domain comprising the sequence:

(SEQ ID NO: 127)

ELVVTQEPSLTVSPGGTVTLTCRSSNGAVTSSNYANWVQQKPGQAPRGLI

GGTNKRAPGTPARFSGSLLEGKAALTLSGVQPEDEAVYYCALWYPNLWVF

GGGTKLTVL.

Also provided are BsAbs comprising, e.g., anti-EGFR antibodies and/or anti-CD3 antibodies disclosed herein. In some embodiments, the bispecific antibodies comprise the VH and VL regions of an anti-EGFR antibody region disclosed herein. In some embodiments, the BsAbs comprise the VH and VL regions of an anti-CD3 antibody disclosed herein. In some embodiments, the BsAbs comprise an anti-EGFR scFv region comprising a VH and VL pair disclosed herein and an anti-CD3 scFV comprising a VH and VL pair disclosed herein. In some embodiments, the BsAbs are TCEs.

In some embodiments, the fusion polypeptide comprises a first ELNN (such as an ELNN described herein). In some embodiments, the polypeptide further comprises a second ELNN (such as an ELNN described herein). In some embodiments, the polypeptide comprises an ELNN at or near its N-terminus (an "N-terminal ELNN"). In some embodiments, the polypeptide comprises an ELNN at or near its C-terminus (a "C-terminal ELNN"). In some embodiments, the polypeptide comprises both an N-terminal ELNN and a C-terminal ELNN.

In some embodiments, a fusion polypeptide comprises a BsAb and a first ELNN is attached to the N-terminus of the BsAb by a first RS and a second ELNN is attached to the C-terminus of the BsAb by a second RS. In some embodiments, each RS is cleavable by a protease mentioned herein. In some embodiments, each RS comprises an RS sequence disclosed herein. In some embodiments, the fusion polypeptide is a paTCE.

Included herein are polypeptide sequences that may be used, e.g., to link one polypeptide moiety to another within a fusion protein. For example, useful linkers are provided that are cleaved by multiple proteases but not legumain. In some embodiments, such linkers may be used outside the context of antibodies such as those described herein.

In some embodiments, a fusion polypeptide (e.g., one or more ELNNs of a paTCE and/or another portion of a fusion polypeptide such as a linker or spacer sequence) can comprise one or more barcode fragments (e.g., as described herein) releasable (e.g., configured to be released) the fusion polypeptide upon cleavage or digestion of the fusion polypeptide (e.g., a paTCE) by a protease. In some embodiments, the protease is a non-mammalian protease. In some embodiments, each barcode fragment differs in sequence and molecular weight from all other peptide fragments (including all other barcode fragments if present) that are releasable from the polypeptide upon complete digestion of the polypeptide by the protease, thereby making it unique and making its presence detectable through techniques such as mass spectrometry.

Extended Recombinant Polypeptides (ELNNs)

Chain Length and Amino Acid Composition

In some embodiments, an ELNN comprises at least 100, or at least 150 amino acids. In some embodiments, an ELNN is from 100 to 3,000, or from 150 to 3,000 amino acids in length. In some embodiments, an ELNN is from 100 to 1,000, or from 150 to 1,000 amino acids in length. In some embodiments, an ELNN is at least (about) 100, at least (about) 150, at least (about) 200, at least (about) 250, at least (about) 300, at least (about) 350, at least (about) 400, at least (about) 450, at least (about) 500, at least (about) 550, at least (about) 600, at least (about) 650, at least (about) 700, at least (about) 750, at least (about) 800, at least (about) 850, at least (about) 900, at least (about) 950, at least (about) 1,000, at least (about) 1,100, at least (about) 1,200, at least (about) 1,300, at least (about) 1,400, at least (about) 1,500, at least (about) 1,600, at least (about) 1,700, at least (about) 1,800, at least (about) 1,900, or at least (about) 2,000 amino acids in length. In some embodiments, an ELNN is at most (about) 100, at most (about) 150, at most (about) 200, at most (about) 250, at most (about) 300, at most (about) 350, at most (about) 400, at most (about) 450, at most (about) 500, at most (about) 550, at most (about) 600, at most (about) 650, at most (about) 700, at most (about) 750, at most (about) 800, at most (about) 850, at most (about) 900, at most (about) 950, at most (about) 1,000, at most (about) 1,100, at most (about) 1,200, at most (about) 1.300, at most (about) 1,400, at most (about) 1,500, at most (about) 1,600, at most (about) 1,700, at most (about) 1,800, at most (about) 1,900, or at most (about) 2,000 amino acids in length. In some embodiments, an ELNN has (about) 100, (about) 150, (about) 200, (about) 250, (about) 300, (about) 350, (about) 400, (about) 450, (about) 500, (about) 550, (about) 600, (about) 650, (about) 700, (about) 750, (about) 800, (about) 850, (about) 900, (about) 950, (about) 1,000, (about) 1,100, (about) 1.200, (about) 1,300, (about) 1,400, (about) 1,500, (about) 1,600, (about) 1,700, (about) 1,800, (about) 1,900, or (about) 2.000 amino acids in length, or of a range between any two of the foregoing. In some embodiments, at least 90% of the amino acid residues of the ELNN are glycine (G), alanine (A), serine(S), threonine (T), glutamate (E) or proline (P). In some embodiments, at least 91%, 92%, 93%, 94%, 95%, 96%, 97%, 98%, 99% or 100% of the amino acid residues of the ELNN are glycine (G), alanine (A), serine(S), threonine (T), glutamate (E) or proline (P). In some embodiments, an ELNN comprises at least 3 different types of amino acids selected from the group consisting of G. A. S. T. E, and P. In some embodiments, an ELNN comprises at least 4 different types of amino acids selected from the group consisting of G, A. S. T. E, and P. In some embodiments, an ELNN comprises at least 5 different types of amino acids selected from the group consisting of G, A. S. T. E, and P. In some embodiments, an ELNN consists of amino acids selected from the group consisting of G, A. S. T. E, and P. In some embodiments, an ELNN comprises G. A. S. T. E, or P amino acids. In some embodiments, an ELNN (e.g., ELNN1, ELNN2, etc.) is characterized in that: (i) it comprises at least 100, or at least 150 amino acids; (ii) at least 90% of the amino acid residues of the ELNN are glycine (G), alanine (A), serine(S), threonine (T), glutamate (E) or proline (P); and (iii) it comprises at least 4 different types of the amino acids from G, A, S. T. E, or P. As used herein, the term "glutamate" is a synonym for "glutamic acid," and refers to the glutamic acid residue whether or not the side-chain carboxyl is deprotonated. In some embodiments, the ELNN-containing fusion polypeptide comprises a first ELNN and a second ELNN. In some embodiments, the sum of the total number of amino acids in the first ELNN and the total number of amino acids in the second ELNN is at least 300, at least 350, at least 400, at least 500, at least 600, at least 700, or at least 800 amino acids.

Non-Overlapping Sequence Motif

In some embodiments, the ELNN comprises, or is formed from, a plurality of non-overlapping sequence motifs. In some embodiments, at least one of the non-overlapping sequence motifs is recurring (or repeated at least two times in the ELNN). In some embodiments, the ELNN comprises at least one other non-overlapping sequence motif that is non-recurring (or found only once within the ELNN). In some embodiments, the plurality of non-overlapping sequence motifs comprises (a) a set of (recurring) non-overlapping sequence motifs, wherein each non-overlapping sequence motif of the set of non-overlapping sequence motifs is repeated at least two times in the ELNN; and (b) a non-overlapping (non-recurring) sequence motif that occurs (or is found) only once within the ELNN. In some embodiments, each non-overlapping sequence motif is from 9 to 14 (or 10 to 14, or 11 to 13) amino acids in length. In some embodiments, each non-overlapping sequence motif is 12 amino acids in length. In some embodiments, the plurality of non-overlapping sequence motifs comprises a set of non-overlapping (recurring) sequence motifs, wherein each non-overlapping sequence motif of the set of non-overlapping sequence motifs is (1) repeated at least two times in the ELNN; and (2) is between 9 and 14 amino acids in length. In some embodiments, the set of (recurring) non-overlapping sequence motifs comprise 12-mer sequence motifs identified herein by SEQ ID NOs: 179-200 and 1715-1722 in Table 1. In some embodiments, the set of (recurring) non-overlapping sequence motifs comprise 12-mer sequence motifs identified herein by SEQ ID NOs: 186-189 in Table 1. In some embodiments, the set of (recurring) non-overlapping sequence motifs comprise at least two, at least three, or all four of 12-mer sequence motifs of SEQ ID NOs: 186-189 in Table 1. In some embodiments, an ELNN further comprises a sequence other than a 12-mer sequence motif shown in Table 1. In some embodiments, an ELNN comprises a sequence that is not in Table 1 such as ASSAT-PESGP (SEQ ID NO:8185), GSGPGTSESATP (SEQ ID NO:8028), or GTSESATP (SEQ ID NO:8032). In some embodiments, an ELNN comprises a sequence that is not in Table 1 such as ATPESGP (SEQ ID NO:8186), GTSPSAT-PESGP (SEQ ID NO:8029), or GTSESAGEPEA (SEQ ID NO:8187). In some embodiments, an ELNN comprises a barcode sequence.

TABLE 1

Exemplary 12-Mer Sequence Motifs for Construction of ELNNs

| Motif Family* | Amino Acid Sequence | SEQ ID NO. |
|---|---|---|
| AD | GESPGGSSGSES | 182 |
| AD | GSEGSSGPGESS | 183 |
| AD | GSSESGSSEGGP | 184 |
| AD | GSGGEPSESGSS | 185 |
| AE, AM | GSPAGSPTSTEE | 186 |
| AE, AM, AQ | GSEPATSGSETP | 187 |
| AE, AM, AQ | GTSESATPESGP | 188 |
| AE, AM, AQ | GTSTEPSEGSAP | 189 |
| AF, AM | GSTSESPSGTAP | 190 |
| AF, AM | GTSTPESGSASP | 191 |
| AF, AM | GTSPSGESSTAP | 192 |
| AF, AM | GSTSSTAESPGP | 193 |

36

TABLE 1-continued

Exemplary 12-Mer Sequence Motifs for Construction of ELNNs

| Motif Family* | Amino Acid Sequence | SEQ ID NO. |
|---|---|---|
| AG, AM | GTPGSGTASSSP | 194 |
| AG, AM | GSSTPSGATGSP | 195 |
| AG, AM | GSSPSASTGTGP | 196 |
| AG, AM | GASPGTSSTGSP | 197 |
| AQ | GEPAGSPTSTSE | 198 |
| AQ | GTGEPSSTPASE | 199 |
| AQ | GSGPSTESAPTE | 200 |
| AQ | GSETPSGPSETA | 179 |
| AQ | GPSETSTSEPGA | 180 |
| AQ | GSPSEPTEGTSA | 181 |
| BC | GSGASEPTSTEP | 1715 |
| BC | GSEPATSGTEPS | 1716 |
| BC | GTSEPSTSEPGA | 1717 |
| BC | GTSTEPSEPGSA | 1718 |
| BD | GSTAGSETSTEA | 1719 |
| BD | GSETATSGSETA | 1720 |
| BD | GTSESATSESGA | 1721 |
| BD | GTSTEASEGSAS | 1722 |

*Denotes individual motif sequences that, when used together in various permutations, results in a "family sequence"

Unstructured Polypeptide Confirmation

In various embodiments, an ELNN component (or the ELNN components) of a fusion protein has an unstructured conformation under physiological conditions, regardless of the length (e.g., extended length) of the polymer. For example, the ELNN is characterized by a large conformational freedom of the peptide backbone. In some embodiments, the ELNN is characterized by a lack of long-range interactions as determined by NMR. In some embodiments, the present disclosure provides ELNNs that, under physiologic conditions, resemble the structure of denatured sequences largely devoid in secondary structure. In some embodiments, the ELNNs can be substantially devoid of secondary structure under physiologic conditions. "Largely devoid," as used in this context, means that less than 50% of the ELNN amino acid residues of the ELNN contribute to secondary structure as measured or determined by the means described herein. "Substantially devoid," as used in this context, means that at least about 60%, or about 70%, or about 80%, or about 90%, or about 95%, or at least about 99% of the ELNN amino acid residues of the ELNN sequence do not contribute to secondary structure, as measured or determined by the means described herein.

A variety of methods have been established in the art to discern the presence or absence of secondary and tertiary structures in a given polypeptide. In some embodiments, ELNN secondary structure can be measured spectrophotometrically, e.g., by circular dichroism spectroscopy in the "far-UV" spectral region (190-250 nm). Secondary structure elements, such as alpha-helix and beta-sheet, each give rise to a characteristic shape and magnitude of CD spectra. Secondary structure can also be predicted for a polypeptide sequence via certain computer programs or algorithms, such as the well-known Chou-Fasman algorithm (Chou, P. Y., et al. (1974) *Biochemistry*, 13:222-45) and the Garnier-Osguthorpe-Robson ("GOR") algorithm (Garnier J, Gibrat J F, Robson B. (1996), GOR method for predicting protein secondary structure from amino acid sequence. Methods Enzymol 266:540-553), as described in US Patent Application Publication No. 20030228309A1 (the entire contents of which are incorporated herein by reference). For a given sequence, the algorithms can predict whether there exists some or no secondary structure at all, expressed as the total and/or percentage of residues of the sequence that form, for example, alpha-helices or beta-sheets or the percentage of residues of the sequence predicted to result in random coil formation (which lacks secondary structure).

In some embodiments, the ELNNs used in a fusion protein composition can have an alpha-helix percentage ranging from 0% to less than about 5% as determined by a Chou-Fasman algorithm. In some embodiments, the ELNNs of the fusion protein compositions can have a beta-sheet percentage ranging from 0% to less than about 5% as determined by a Chou-Fasman algorithm. In some embodiments, the ELNNs of the fusion protein compositions can have an alpha-helix percentage ranging from 0% to less than about 5% and a beta-sheet percentage ranging from 0% to less than about 5% as determined by a Chou-Fasman algorithm. In some embodiments, the ELNNs of the fusion protein compositions will have an alpha-helix percentage less than about 2% and a beta-sheet percentage less than about 2%. In some embodiments, the ELNNs of the fusion protein compositions can have a high degree of random coil percentage, as determined by a GOR algorithm. In some embodiments, an ELNN can have at least about 80%, more preferably at least about 90%, more preferably at least about 91%, more preferably at least about 92%, more preferably at least about 93%, more preferably at least about 94%, more preferably at least about 95%, more preferably at least about 96%, more preferably at least about 97%, more preferably at least about 98%, and most preferably at least about 99% random coil, as determined by a GOR algorithm.

Net Charge

In some embodiments, the ELNN polypeptides can have an unstructured characteristic imparted by incorporation of amino acid residues with a net charge and/or reducing the proportion of hydrophobic amino acids in the ELNN sequence. The overall net charge and net charge density may be controlled, e.g., by modifying the content of charged amino acids in the ELNNs. In some embodiments, the net charge density of the ELNN of the compositions may be above +0.1 or below-0.1 charges/residue. In some embodiments, the net charge of a ELNN can be about 0%, about 1%, about 2%, about 3%, about 4%, about 5%, about 6%, about 7%, about 8%, about 9%, about 10% about 11%, about 12%, about 13%, about 14%, about 15%, about 16%, about 17%, about 18%, about 19%, or about 20% or more.

Since most tissues and surfaces in a human or animal have a net negative charge, the ELNNs can optionally be designed to have a net negative charge to minimize non-specific interactions between the ELNN containing compositions and various surfaces such as blood vessels, healthy tissues, or various receptors. Not to be bound by a particular theory, an ELNN may adopt open conformations due to electrostatic repulsion between individual amino acids of the ELNN polypeptide that individually carry a high net negative charge and that are distributed across the sequence of the ELNN polypeptide. Such a distribution of net negative charge in the extended sequence lengths of ELNN can lead to an unstructured conformation that, in turn, can result in an effective increase in hydrodynamic radius. Accordingly, in some embodiments the ELNNs contain glutamic acid such that the glutamic acid is at about 8, 10, 15, 20, 25, or even about 30% of the amino acids in the sequences. The ELNN of the compositions of the present disclosure generally have no or a low content of positively charged amino acids. In some embodiments the ELNN may have less than about 10% amino acid residues with a positive charge, or less than about 7%, or less than about 5%, or less than about 2% amino acid residues with a positive charge. However, the present disclosure contemplates polypeptides where a limited number of amino acids with a positive charge, such as lysine, may be incorporated into an ELNN, e.g., to permit conjugation between the epsilon amine of the lysine and a reactive group on a peptide, a linker bridge, or a reactive group on a drug or small molecule to be conjugated to the ELNN backbone.

In some embodiments, an ELNN may comprise charged residues separated by other residues such as serine or glycine, which may lead to better expression or purification behavior. Based on the net charge, ELNNs of the subject compositions may have an isoelectric point (pI) of 1.0, 1.5, 2.0, 2.5, 3.0, 3.5, 4.0, 4.5, 5.0, 5.5, 6.0, or even 6.5. In some embodiments, the ELNN will have an isoelectric point between 1.5 and 4.5. In some embodiments, an ELNN incorporated into an paTCE fusion protein carries a net negative charge under physiologic conditions contributes to the unstructured conformation and reduced binding of the ELNN component to mammalian proteins and tissues.

As hydrophobic amino acids can impart structure to a polypeptide, in some embodiments the content of hydrophobic amino acids in the ELNN is less than 5%, or less than 2%, or less than 1% hydrophobic amino acid content. In some embodiments, an ELNN has no hydrophobic amino acids. In some embodiments, the amino acid content of methionine and tryptophan in the ELNN component of a paTCE fusion protein is less than 5%, or less than 2%, and most preferably less than 1%. In some embodiments, the ELNN has a sequence that has less than 10% amino acid residues with a positive charge, or less than about 7%, or less that about 5%, or less than about 2% amino acid residues with a positive charge, the sum of methionine and tryptophan residues will be less than 2%, and the sum of asparagine and glutamine residues will be less than 10% of the total ELNN sequence. In some embodiments, the ELNN has no methionine or tryptophan residues.

Increased Hydrodynamic Radius

In some embodiments, the ELNN can have a high hydrodynamic radius, conferring a corresponding increased Apparent Molecular Weight to the paTCE fusion protein which incorporates the ELNN. The linking of ELNNs to BsAb (e.g., TCE) sequences can result in paTCE compositions that can have increased hydrodynamic radii, increased Apparent Molecular Weight, and increased Apparent Molecular Weight Factor compared to BsAbs (e.g., TCEs) not linked to an ELNN. For example, in some therapeutic applications in which prolonged half-life is desired, one or more ELNNs with a high hydrodynamic radius are incorporated into a fusion protein comprising a BsAb (e.g., a TCE) to effectively enlarge the hydrodynamic radius of the fusion protein beyond the glomerular pore size of approximately 3-5 nm (corresponding to an apparent molecular weight of about 70 kDa) (Caliceti. 2003. Pharmacokinetic and biodistribution properties of poly(ethylene glycol)-protein conjugates. Adv. Drug Deliv. Rev. 55:1261-1277), resulting in reduced renal clearance of circulating proteins. In some embodiments, the hydrodynamic radius of a protein is determined by its molecular weight as well as by its structure, including shape and compactness. Not to be bound by a particular theory, the ELNN may adopt open conformations due to electrostatic repulsion between individual charges of the peptide or the inherent flexibility imparted by the particular amino acids in the sequence that lack potential to confer secondary structure. In some embodiments, the open, extended and unstructured conformation of the ELNN polypeptide has a greater proportional hydrodynamic radius compared to polypeptides of a comparable sequence length and/or molecular weight that have secondary and/or tertiary structure, such as typical globular proteins. Methods for determining the hydrodynamic radius are well known in the art, such as by the use of size exclusion chromatography (SEC), as described in U.S. Pat. Nos. 6,406,632 and 7,294, 513. In some embodiments, the addition of increasing lengths of ELNN results in proportional increases in the parameters of hydrodynamic radius, Apparent Molecular Weight, and Apparent Molecular Weight Factor, permitting the tailoring of paTCE to desired characteristic cut-off Apparent Molecular Weights or hydrodynamic radii. Accordingly, in some embodiments, the paTCE fusion protein can be configured with an ELNN such that the fusion protein can have a hydrodynamic radius of at least about 5 nm, or at least about 8 nm, or at least about 10 nm, or 12 nm, or at least about 15 nm. In some embodiments, the large hydrodynamic radius conferred by the ELNN in an paTCE fusion protein can lead to reduced renal clearance of the resulting fusion protein, leading to a corresponding increase in terminal half-life, an increase in mean residence time, and/or a decrease in renal clearance rate.

In some embodiments, an ELNN (or multiple ELNNs, such as two ELNNs) of a chosen length and sequence can be selectively incorporated into a paTCE to create a fusion protein that will have, under physiologic conditions, an Apparent Molecular Weight of at least about 150 kDa, or at least about 300 kDa, or at least about 400 kDa, or at least about 500 kDa, or at least about 600 kDa, or at least about 700 kDa, or at least about 800 kDa, or at least about 900 kDa, or at least about 1000 kDa, or at least about 1200 kDa, or at least about 1500 kDa, or at least about 1800 kDa, or at least about 2000 kDa, or at least about 2300 kDa or more. In some embodiments, an ELNN (or multiple ELNNs, such as two ELNNs) of a chosen length and sequence can be selectively linked to a BsAb (e.g., a TCE) to result in a paTCE fusion protein that has, under physiologic conditions, an Apparent Molecular Weight Factor of at least 3, alternatively of at least 4, alternatively of at least 5, alternatively of at least 6, alternatively of at least 7, alternatively of at least 8, alternatively of at least 9, alternatively of at least 10, alternatively of at least 15, or an Apparent Molecular Weight Factor of at least 20 or greater. In some embodiments, the paTCE fusion protein has, under physiologic conditions, an Apparent Molecular Weight Factor that is about 4 to about 20, or is about 6 to about 15, or is about 8 to about 12, or is about 9 to about 10 relative to the actual molecular weight of the fusion protein. In some embodiments, the fusion polypeptide exhibits an apparent molecular weight factor under physiological conditions that is greater than about 6.

Increased Terminal Half-Life

In some embodiments, a fusion polypeptide comprising an ELNN (such as a paTCE) has a terminal half-life that is at least two-fold longer, or at least three-fold longer, or at least four-fold longer, or at least five-fold longer, compared to a corresponding biologically active polypeptide that is not linked to the ELNN. In some embodiments, the (fusion) polypeptide has a terminal half-life that is at least two-fold longer compared to the biologically active polypeptide not linked to the ELNN.

In some embodiments, administration of a therapeutically effective amount of a paTCE fusion protein to a subject in need thereof results in a gain in time of at least two-fold, or at least three-fold, or at least four-fold, or at least five-fold or more spent within a therapeutic window for the fusion protein compared to the corresponding BsAb (e.g., TCE) not linked to the ELNN(s) when administered at a comparable dose to a subject.

In some embodiments, a TCE released from a paTCE upon protease cleavage comprises one or more short polypeptides (e.g., about 30, 25, 20, 15, 14, 13, 12, 11, 10, or less amino acids in length) that has no amino acids other than G. A. P. E. S. and/or T. For example, a short polypeptide that has no amino acids other than G, A. P. E. S. and/or T might be incorporated into one or more spacer or linker sequences of the TCE, and/or a portion of one or more spacers or linkers that remain part of the TCE after cleavage. In some embodiments, a TCE that is released from a paTCE comprises a GTSESATPES (SEQ ID NO:96) on the N-terminal side (e.g., the closest amino acid of the sequence is within 10, 9, 8, 7, 6, 5, 4, 3, 2, or 1 amino acid positions of the N-terminal amino acid or the sequence includes the N-terminus) of the TCE. In some embodiments, a TCE that is released from a paTCE comprises a GTATPESGPG (SEQ ID NO: 97) on the C-terminal side (e.g., the closest amino acid of the sequence is within 10, 9, 8, 7, 6, 5, 4, 3, 2, or 1 amino acid positions of the N-terminal amino acid or the sequence includes the N-terminus) of the TCE. In some embodiments, a TCE comprises an internal linker (e.g., between a VL region and a VH region of a scFV) that comprises a polypeptide sequence with no amino acids other than G, A, P. E. S, and/or T, such as SESATPESGPGTSP-GATPESGPGTSESATP (SEQ ID NO: 81).

Low Immunogenicity

In some embodiments, the present disclosure provides compositions in which the ELNNs have a low degree of immunogenicity or are substantially non-immunogenic. Several factors can contribute to the low immunogenicity of an ELNN, e.g., the substantially non-repetitive sequence, the unstructured conformation, the high degree of solubility, the low degree or lack of self-aggregation, the low degree or lack of proteolytic sites within the sequence, and the low degree or lack of epitopes in the ELNN.

One of ordinary skill in the art will understand that, in general, polypeptides having highly repetitive short amino acid sequences (e.g., wherein a 200 amino acid-long sequence contain on average 20 repeats or more of a limited set of 3- or 4-mers) and/or having contiguous repetitive amino acid residues (e.g., wherein 5- or 6-mer sequences have identical amino acid residues) have a tendency to aggregate or form higher order structures or form contacts resulting in crystalline or pseudo-crystalline structures.

In some embodiments, a ELNN sequence is substantially non-repetitive, wherein (1) the ELNN sequence has no three contiguous amino acids that are identical amino acid types, unless the amino acid is serine, in which case no more than three contiguous amino acids can be serine residues; and wherein (2) the ELNN contains no 3-amino acid sequences (3-mers) that occur more than 16, more than 14, more than 12, or more than 10 times within an at least 200 amino acid-long sequence of the ELNN (e.g., the entire span of an ELNN that is at least amino acids long). Without being bound by any scientific theory, such substantially non-repetitive sequences have less tendency to aggregate and, thus, enable the design of long-sequence ELNNs with a relatively low frequency of charged amino acids that would be likely to aggregate if the sequences or amino acid residues were otherwise more repetitive.

Conformational epitopes can be formed by regions of protein surfaces that are composed of multiple discontinuous amino acid sequences of a protein antigen. Without being bound by any scientific theory, the precise folding of the protein may bring these sequences into well-defined, stable spatial configurations or epitopes that can be recognized as "foreign" by the host humoral immune system, resulting in the production of antibodies to the protein and/or triggering a cell-mediated immune response. In the latter case, the immune response to a protein in an individual is heavily influenced by T-cell epitope recognition that is a function of the peptide binding specificity of that individual's HLA-DR allotype. Engagement of an MHC Class II peptide complex by a cognate T-cell receptor on the surface of the T-cell, together with the cross-binding of certain other co-receptors such as the CD4 molecule, can induce an activated state within the T-cell. Activation may lead to the release of cytokines further activating other lymphocytes such as B cells to produce antibodies or activating T killer cells as a full cellular immune response.

Without being bound by any scientific theory, the ability of a peptide to bind a given MHC Class II molecule for presentation on the surface of an APC (antigen presenting cell) may depend on a number of factors; most notably its primary sequence. In some embodiments, a lower degree of immunogenicity may be achieved by designing ELNNs that resist antigen processing in antigen presenting cells, and/or choosing sequences that do not bind MHC receptors well. In some embodiments, ELNN-containing fusion proteins have substantially non-repetitive ELNN polypeptides designed to reduce binding with MHC II receptors, as well as to avoid formation of epitopes for T-cell receptor or antibody binding, resulting in a low degree of immunogenicity. Without being bound by any scientific theory, avoidance of immunogenicity is, in part, a direct result of the conformational flexibility of ELNNs; i.e., the lack of secondary structure due to the selection and order of amino acid residues. For example, of particular interest are sequences having a low tendency to adapt compactly folded conformations in aqueous solution or under physiologic conditions that could result in conformational epitopes. The administration of fusion proteins comprising ELNNs, using conventional therapeutic practices and dosing, would generally not result in the formation of neutralizing antibodies to the ELNNs, and may also reduce the immunogenicity of BsAb (e.g., TCE) fusion partners in paTCE compositions.

In some embodiments, the ELNNs utilized in the subject fusion proteins can be substantially free of epitopes recognized by human T cells. The elimination of such epitopes for the purpose of generating less immunogenic proteins has been disclosed previously; see for example WO 98/52976, WO 02/079232, and WO 00/3317 which are incorporated by reference herein. Assays for human T cell epitopes have been described (Stickler, M., et al. (2003) *J Immunol Methods,* 281:95-108). Of particular interest are peptide sequences that can be oligomerized without generating T cell epitopes or non-human sequences. This can be achieved by testing direct repeats of these sequences for the presence of T-cell epitopes and for the occurrence of 6 to 15-mer and, in particular, 9-mer sequences that are not human, and then altering the design of the ELNN sequence to eliminate or disrupt the epitope sequence. In some embodiments, the ELNNs are substantially non-immunogenic by the restriction of the numbers of epitopes of the ELNN predicted to bind MHC receptors. With a reduction in the numbers of epitopes capable of binding to MHC receptors, there is a concomitant reduction in the potential for T cell activation as well as T cell helper function, reduced B cell activation or upregulation and reduced antibody production. The low degree of predicted T-cell epitopes can be determined by epitope prediction algorithms such as, e.g., TEPITOPE (Sturniolo, T., et al. (1999) Nat Biotechnol, 17:555-61), as shown in Example 74 of International Patent Application Publication No. WO 2010/144502 A2, which is incorporated by reference in its entirety. Aspects of the TEPITOPE score of a given peptide frame within a protein are disclosed in Sturniolo, T. et al. (1999) *Nature Biotechnology* 17:555). The score ranges over at least 20 logs, from about 10 to about −10 (corresponding to binding constraints of $10e^{10}$ $k_D$ to $10e^{-10}$ $k_D$), and can be reduced by avoiding hydrophobic amino acids that can serve as anchor residues during peptide display on MHC, such as M, I, L, V, or F. In some embodiments, an ELNN component incorporated into a paTCE does not have a predicted T-cell epitope at a TEPITOPE score of about −5 or greater, or −6 or greater, or −7 or greater, or −8 or greater, or at a TEPITOPE score of −9 or greater. As used herein, a score of "−9 or greater" would encompass TEPITOPE scores of 10 to −9, inclusive, but would not encompass a score of −10, as −10 is less than −9.

In some embodiments, the ELNNs, including those incorporated into the subject paTCE fusion proteins, can be rendered substantially non-immunogenic by the restriction of known proteolytic sites from the sequence of the ELNN, reducing the processing of ELNN into small peptides that can bind to MHC II receptors. In some embodiments, the ELNN sequence can be rendered substantially non-immunogenic by the use a sequence that is substantially devoid of secondary structure, conferring resistance to many proteases due to the high entropy of the structure. Accordingly, the reduced TEPITOPE score and elimination of known proteolytic sites from the ELNN may render the ELNN compositions, including the ELNN of the paTCE fusion protein compositions, substantially unable to be bound by mammalian receptors, including those of the immune system. In some embodiments, an ELNN of a paTCE fusion protein can have >100 nM $k_D$ binding to a mammalian receptor, or greater than 500 nM $k_D$, or greater than 1 µM $k_D$ towards a mammalian cell surface or circulating polypeptide receptor.

Additionally, the substantially non-repetitive sequence and corresponding lack of epitopes of such embodiments of ELNNs can limit the ability of B cells to bind to or be activated by the ELNNs. In some embodiments, while an ELNN can make contacts with many different B cells over its extended sequence, each individual B cell may only make one or a small number of contacts with an individual ELNN. As a result, ELNNs typically may have a much lower tendency to stimulate proliferation of B cells and thus an immune response. In some embodiments, the paTCE may have reduced immunogenicity as compared to the corresponding BsAb (e.g., TCE) that is not fused to a mask polypeptide such as an ELNN. In some embodiments, the administration of up to three parenteral doses of a paTCE to a mammal may result in detectable anti-paTCE IgG at a serum dilution of 1:100 but not at a dilution of 1:1000. In some embodiments, the administration of up to three parenteral doses of an paTCE to a mammal may result in detectable anti-BsAb (e.g., TCE) IgG at a serum dilution of 1:100 but not at a dilution of 1:1000. In some embodiments, the administration of up to three parenteral doses of an paTCE to a mammal may result in detectable anti-ELNN IgG at a serum dilution of 1:100 but not at a dilution of 1:1000. In some embodiments, the mammal can be, e.g., a mouse, a rat, a rabbit, cynomolgus monkey, or human. In some embodiments, the mammal is a human.

An additional feature of certain ELNNs with substantially non-repetitive sequences relative to those less non-repetitive sequences (such as one having three contiguous amino acids that are identical) can be that non-repetitive ELNNs form weaker contacts with antibodies (e.g., monovalent interactions), thereby resulting in less likelihood of immune clearance such that the paTCE compositions can remain in circulation for an increased period of time.

In some embodiments, a biologically active polypeptide (such as a BsAb, e.g., a TCE) comprising an ELNN is less immunogenic compared to the fusion polypeptide not linked to any ELNN, wherein immunogenicity is ascertained by measuring production of IgG antibodies that selectively bind to the biologically active polypeptide after administration of comparable doses to a subject.

Barcode Fragment

In some embodiments, a polypeptide (e.g., a fusion polypeptide or a portion thereof such as an ELNN) comprises one or more barcode fragments (e.g., a first, second, or third barcode fragment) releasable from the polypeptide upon digestion by a protease. In some embodiments, the protease is a non-mammalian protease. In some embodiments, the protease is a prokaryotic protease. As used herein, the term "barcode fragment" (or "barcode." or "barcode sequence") can refer to either the portion of the polypeptide cleavably fused within the polypeptide, or the resulting peptide fragment released from the polypeptide.

In some embodiments, a barcode fragment (1) is a portion of an ELNN that includes at least part of the (non-recurring, non-overlapping) sequence motif that occurs (or is found) only once within the ELNN; and (2) differs in sequence and molecular weight from all other peptide fragments that are releasable from the polypeptide upon cleavage or complete digestion of the polypeptide by the protease.

In some embodiments, a barcode fragment does not include the N-terminal amino acid or the C-terminal amino acid of the fusion polypeptide. As described herein, in some embodiments, a barcode fragment is releasable (e.g., configured to be released) upon Glu-C digestion of the fusion polypeptide. In some embodiments, a barcode fragment is in an ELNN and does not include a glutamic acid that is immediately adjacent to another glutamic acid, if present, in the ELNN. In some embodiments, a barcode fragment has a glutamic acid at its C-terminus. One of ordinary skill in the art will understand that the C-terminus of a barcode fragment can refer to the "last" (or the most C-terminal) amino acid residue within the barcode fragment, when cleavably fused within a polypeptide (such as an ELNN), even if other non-barcode amino acid residues are positioned C-terminal to the barcode fragment within the polypeptide (e.g., ELNN). In some embodiments, a barcode fragment has an N-terminal amino acid that is immediately preceded by a glutamic acid residue. In some embodiments, the glutamic acid residue that precedes the N-terminal amino acid is not immediately adjacent to another glutamic acid residue. In some embodiments, a barcode fragment does not include a (second) glutamic acid residue at a position other than the C-terminus of the barcode fragment unless the glutamic acid is immediately followed by a proline. In some embodiments, a barcode fragment is positioned a distance from either the N-terminus of the polypeptide or the C-terminus of the polypeptide, wherein the distance is from 10 to 150, or 10 to 125 amino acids. In some embodiments, a barcode fragment is positioned within, or at a location of, 300, 280, 260, 250, 240, 220, 200, 190, 180, 170, 160, 150, 140, 130, 120, 110, 100, 90, 80, 70, 60, 50, 48, 40, 36, 30, 24, 20, 12, or 10 amino acids from the N-terminus of the polypeptide, or at a location in a range between any of the foregoing. In some embodiments, a barcode fragment is positioned within 200, within 150, within 100, or within 50 amino acids of the N-terminus of the polypeptide. In some embodiments, a barcode fragment is positioned at a location that is between 10 and 200, between 30 and 200, between 40 and 150, or between 50 and 100 amino acids from the N-terminus of the polypeptide. In some embodiments, a barcode fragment is positioned within, or at a location of, 300, 280, 260, 250, 240, 220, 200, 190, 180, 170, 160, 150, 140, 130, 120, 110, 100, 90, 80, 70, 60, 50, 48, 40, 36, 30, 24, 20, 12, or 10 amino acids from the C-terminus of the polypeptide, or at a location in a range between any of the foregoing. In some embodiments, a barcode fragment is positioned within 200, within 150, within 100, or within 50 amino acids of the C-terminus of the polypeptide. In some embodiments, a barcode fragment is positioned at a location that is between 10 and 200, between 30 and 200, between 40 and 150, or between 50 and 100 amino acids from the C-terminus of the polypeptide. In some embodiments, a barcode fragment (BAR) is characterized in that: (i) it does not include a glutamic acid that is immediately adjacent to another glutamic acid, if present, in the ELNN; (ii) it has a glutamic acid at its C-terminus; (iii) it has an N-terminal amino acid that is immediately preceded by a glutamic acid residue; and (iv) it is positioned a distance from either the N-terminus of the polypeptide or the C-terminus of the polypeptide, wherein the distance is from 10 to 150 amino acids, or from 10 to 125 amino acids in length. In some embodiments, a barcode fragment is in an ELNN and (i) does not include the N-terminal amino acid or the C-terminal amino acid of the polypeptide; (ii) does not include a glutamic acid that is immediately adjacent to another glutamic acid in the ELNN; (iii) has a glutamic acid at its C-terminus; (iv) has an N-terminal amino acid that is immediately preceded by a glutamic acid residue; and (v) is positioned a distance from either the N-terminus of the polypeptide or the C-terminus of the polypeptide, wherein the distance is from 10 to 150, or 10 to 125 amino acids in length. In some embodiments, the glutamic acid residue that precedes the N-terminal amino acid is not immediately adjacent to another glutamic acid residue. In some embodiments, a barcode fragment does not include a glutamic acid residue at a position other than the C-terminus of the barcode fragment unless the glutamic acid is immediately followed by a proline. Depending on context herein and when referring to placement within a polypeptide sequence, the term "distance" can refer to the number of amino acid residues from the N-terminus of the polypeptide to the most N-terminal amino acid residue of the barcode fragment, or from the C-terminus of the polypeptide to the most C-terminal amino acid residue of the barcode fragment. In some embodiments, for a barcoded ELNN fused to a biologically active polypeptide, at least one barcode fragment (or at least two barcode fragments, or three barcode fragments) contained in the barcoded ELNN is positioned at least 50, 75, 100, 125, 150, 175, 200, 225, 250, 275, 300 amino acids from the biologically active polypeptide. In some embodiments, a barcode fragment is at least 4, at least 5, at least 6, at least 7, or at least 8 amino acids in length. In some embodiments, a barcode fragment is at least 4 amino acids in length. In some embodiments, a barcode fragment is 4, 5, 6, 7, 8, 9, 10, 11, 12, 13, 14, 15, 16, 17, 18, 19, 20, 21, 22, 23, 24, 25 amino acids in length, or in a range between any of the foregoing values. In some embodiments, a barcode fragment is between 4 and 20, between 5 and 15, between 6 and 12, or between 7 and 10 amino acids in length. In some embodiments, a barcode fragment comprises an amino acid sequence identified herein by SEQ ID NOs: 68-79 and SEQ ID NOs: $1010^{-1027}$ in Table 2.

TABLE 2

| Exemplary Barcode Fragments Releasable Upon Glu-C Digest | |
| --- | --- |
| Amino Acid Sequence | SEQ ID NO: |
| SPATSGSTPE | 68 |
| GSAPATSE | 69 |
| GSAPGTATE | 70 |
| GSAPGTE | 71 |
| PATSGPTE | 72 |
| SASPE | 73 |
| PATSGSTE | 74 |
| GSAPGTSAE | 75 |
| SATSGSE | 76 |
| SGPGSTPAE | 77 |
| SGPGSGPGTSE | 78 |
| SGPGTSPSATPE | 79 |
| SGPGTGTSATPE | 1010 |
| SGPGTTPGTTPE | 1011 |
| SGPGTPPTSTPE | 1012 |
| SGPGTGSAGTPE | 1013 |
| SGPGTGGAGTPE | 1014 |
| SGPGTSPGATPE | 1015 |
| SGPGTSGSGTPE | 1016 |
| SGPGTSSASTPE | 1017 |
| SGPGTGAGTTPE | 1018 |
| SGPGTGSTSTPE | 1019 |
| TPGSEPATSGSE | 1020 |
| GSAPGTSTEPSE | 1021 |
| SGPGTAGSGTPE | 1022 |
| SGPGTSSGGTPE | 1023 |
| SGPGTAGPATPE | 1024 |
| SGPGTPGTGTPE | 1025 |
| SGPGTGGPTTPE | 1026 |
| SGPGTGSGSTPE | 1027 |

In some embodiments, each barcode fragment differs in both sequence and molecular weight from all other peptide fragments that are releasable from the chimeric polypeptides described herein upon complete digestion the chimeric polypeptide by a non-mammalian protease. In some embodiments, the non-mammalian protease is Glu-C.

In some embodiments, the chimeric polypeptides disclosed herein comprises a Glu-C cleavage site comprising one of the following amino acid sequences: ATPESGPG (SEQ ID NO:8030), SGSETPGT (SEQ ID NO:8031), and GTSESATP (SEQ ID NO:8032).

In some embodiments, the chimeric polypeptides disclosed herein comprises at least one of the following amino acid sequences: PE.GSX$_n$PE.SG (SEQ ID NO:8188), PE.GSX$_n$SE.GG (SEQ ID NO: 8189), PE.GSX$_n$SE.TG (SEQ ID NO:8191), PE.GSX$_n$SE.SA (SEQ ID NO:8192), PE.SGX$_n$PE.SG (SEQ ID NO:8193), PE.SGX$_n$SE.GG (SEQ ID NO:8195), PE.SGX$_n$SE.TG (SEQ ID NO: 8196), PE.SGX$_n$SE.SA (SEQ ID NO:8197), and PE.TPX$_n$PE.SG (SEQ ID NO:8199), PE.TPX$_n$SE.GG (SEQ ID NO:8200), PE.TPX$_n$SE.TG (SEQ ID NO:8201), PE.TPX$_n$SE.SA (SEQ ID NO: 8203), wherein each "." is a Glu-C cleavage site and n is any integer from 0 to 50. In some embodiments, the chimeric polypeptides disclosed herein comprises at least one of the following amino acid sequences: PE.SGX$_n$PE.SG (SEQ ID NO:8194), PE.GSX$_n$SE.GG (SEQ ID NO:8190), PE.TPX$_n$SE.TG (SEQ ID NO:8202), PE.SGX$_n$SE.SA (SEQ ID NO:8198). In some embodiments, n is any integer from 1 to 20. In some embodiments, n is any integer from 5 to 15. In some embodiments, n is any integer from 5 to 10. In some embodiments, n is 9. In some embodiments, n is any integer from 5 to 15. In some embodiments, X$_{11}$ is SGPGTGT-SATPE (SEQ ID NO:1010), SGPGSGPGTSE (SEQ ID NO:78), SGPGTTPGTTPE (SEQ ID NO:1011), SGPGTPPTSTPE (SEQ ID NO:1012), SGPGTSPSATPE (SEQ ID NO: 79), SGPGTGSAGTPE (SEQ ID NO:1013), SGPGTGGAGTPE (SEQ ID NO:1014), SGPGTSPGATPE (SEQ ID NO:1015), SGPGTSGSGTPE (SEQ ID NO:1016), SGPGTSSASTPE (SEQ ID NO: 1017), SGPGTGAGTTPE (SEQ ID NO:1018), SGPGTGSTSTPE (SEQ ID NO:1019), TPGSEPATSGSE (SEQ ID NO:1020), GSAPGTSTEPSE (SEQ ID NO:1021), SGPGTAGSGTPE (SEQ ID NO: 1022), SGPGTSSGGTPE (SEQ ID NO:1023), SGPGTAGPATPE (SEQ ID NO:1024), SGPGTPGTGTPE (SEQ ID NO:1025), SGPGTGGPTTPE (SEQ ID NO:1026), or SGPGTGSGSTPE (SEQ ID NO:1027).

In some embodiments, a chimeric polypeptide comprises at least one of the following amino acid sequences:

| | | | |
| --- | --- | --- | --- |
| SGPE.SGPGX$_n$SGPE.SGPG | (SEQ | ID | NO:8033), |
| SGPE.SGPGX$_n$ATPE.SGPG | (SEQ | ID | NO:8034), |
| SGPE.SGPGX$_n$GTSE.SATP | (SEQ | ID | NO:8036), |
| SGPE.SGPGX$_n$TTPE.SGPG | (SEQ | ID | NO:8037), |
| SGPE.SGPGX$_n$STPE.SGPG | (SEQ | ID | NO:8038), |
| SGPE.SGPGX$_n$GTPE.SGPG | (SEQ | ID | NO:8039), |
| SGPE.SGPGX$_1$GTPE.TPGS | (SEQ | ID | NO:8040), |
| SGPE.SGPGX$_n$GTPE.TPGS | (SEQ | ID | NO:8040), |
| SGPE.SGPGX$_n$SGSE.TGTP | (SEQ | ID | NO:8041), |
| SGPE.SGPGX$_n$GTPE.GSAP | (SEQ | ID | NO:8042), |
| SGPE.SGPGX$_n$EPSE.SATP | (SEQ | ID | NO:8043), |
| ATPE.SGPGX$_n$SGPE.SGPG | (SEQ | ID | NO:8044), |
| ATPE.SGPGX$_n$ATPE.SGPG | (SEQ | ID | NO:8045), |
| ATPE.SGPGX$_n$GTSE.SATP | (SEQ | ID | NO:8047), |
| ATPE.SGPGX$_n$TTPE.SGPG | (SEQ | ID | NO:8049), |
| ATPE.SGPGX$_n$STPE.SGPG | (SEQ | ID | NO:8051), |
| ATPE.SGPGX$_n$GTPE.SGPG | (SEQ | ID | NO:8053), |
| ATPE.SGPGX$_n$GTPE.TPGS | (SEQ | ID | NO:8055), |
| ATPE.SGPGX$_n$SGSE.TGTP | (SEQ | ID | NO:8056), |

ATPE.SGPGX$_n$GTPE.GSAP (SEQ ID NO:8057), ATPE.SGPGX$_n$EPSE.SATP (SEQ ID NO:8058), GTS-E.SATPX$_n$SGPE.SGPG (SEQ ID NO:8059), GTS-E.SATPX$_n$ATPE.SGPG (SEQ ID NO:8060), GTS-E.SATPX$_n$GTSE.SATP (SEQ ID NO:8061), GTSE.SATPX$_n$TTPE.SGPG (SEQ ID NO:8062), GTS-E.SATPX$_n$STPE.SGPG (SEQ ID NO:8063), GTS-E.SATPX$_n$GTPE.SGPG (SEQ ID NO:8064). GTS-E.SATPX$_n$GTPE.TPGS (SEQ ID NO:8065). GTSE.SATPX$_n$SGSE.TGTP (SEQ ID NO:8066). GTS-E.SATPX$_n$GTPE.GSAP (SEQ ID NO:8067). GTS-E.SATPX$_n$EPSE.SATP (SEQ ID NO:8068). TTPE.SGPGX$_n$SGPE.SGPG (SEQ ID NO:8069). TTPE.SGPGX$_n$ATPE.SGPG (SEQ ID NO:8070). TTPE.SGPGX$_n$GTSE.SATP (SEQ ID NO:8071). TTPE.SGPGX$_n$TTPE.SGPG (SEQ ID NO:8072). TTPE.SGPGX$_n$STPE.SGPG (SEQ ID NO:8074). TTPE.SGPGX$_n$GTPE.SGPG (SEQ ID NO:8075). TTPE.SGPGX$_n$GTPE.TPGS (SEQ ID NO:8076). TTPE.SGPGX$_n$SGSE.TGTP (SEQ ID NO:8077). TTPE.SGPGX$_n$GTPE.GSAP (SEQ ID NO:8078), TTPE.SGPGX$_n$EPSE.SATP (SEQ ID NO:8079). STPE.SGPGX$_n$SGPE.SGPG (SEQ ID NO:8080). STPE.SGPGX$_n$ATPE.SGPG (SEQ ID NO:8081). STPE.SGPGX$_n$GTSE.SATP (SEQ ID NO:8082). STPE.SGPGX$_n$TTPE.SGPG (SEQ ID NO:8083). STPE.SGPGX$_n$STPE.SGPG (SEQ ID NO:8084). STPE.SGPGX$_n$GTPE.SGPG (SEQ ID NO:8086). STPE.SGPGX$_n$GTPE.TPGS (SEQ ID NO:8087). STPE.SGPGX$_n$SGSE.TGTP (SEQ ID NO:8088), STPE.SGPGX$_n$GTPE.GSAP (SEQ ID NO:8089), STPE.SGPGX$_n$EPSE.SATP (SEQ ID NO:8090). GTPE.SGPGX$_n$SGPE.SGPG (SEQ ID NO:8091). GTPE.SGPGX$_n$ATPE.SGPG (SEQ ID NO:8092), GTPE.SGPGX$_n$GTSE.SATP (SEQ ID NO:8093). GTPE.SGPGX$_n$TTPE.SGPG (SEQ ID NO:8094). GTPE.SGPGX$_n$STPE.SGPG (SEQ ID NO:8096). GTPE.SGPGX$_n$GTPE.SGPG (SEQ ID NO:8098). GTPE.SGPGX$_n$GTPE.TPGS (SEQ ID NO:8100). GTPE.SGPGX$_n$SGSE.TGTP (SEQ ID NO:8101). GTPE.SGPGX$_n$GTPE.GSAP (SEQ ID NO:8102), GTPE.SGPGX$_n$EPSE.SATP (SEQ ID NO:8103). GTPE.TPGSX$_n$SGPE.SGPG (SEQ ID NO:8104). GTPE.TPGSX$_n$ATPE.SGPG (SEQ ID NO:8105), GTPE.TPGSX$_n$GTSE.SATP (SEQ ID NO:8106). GTPE.TPGSX$_n$TTPE.SGPG (SEQ ID NO:8107). GTPE.TPGSX$_n$STPE.SGPG (SEQ ID NO:8108), GTPE.TPGSX$_n$GTPE.SGPG (SEQ ID NO:8109), GTPE.TPGSX$_n$GTPE.TPGS (SEQ ID NO:8110). GTPE.TPGSX$_n$SGSE.TGTP (SEQ ID NO:8111), GTPE.TPGSX$_n$GTPE.GSAP (SEQ ID NO:8113). GTPE.TPGSX$_n$EPSE.SATP (SEQ ID NO:8114). SGSE.TGTPX$_n$SGPE.SGPG (SEQ ID NO:8115), SGSE.TGTPX$_n$ATPE.SGPG (SEQ ID NO:8116), SGSE.TGTPX$_n$GTSE.SATP (SEQ ID NO:8117), SGSE.TGTPX$_n$TTPE.SGPG (SEQ ID NO:8118). SGSE.TGTPX$_n$STPE.SGPG (SEQ ID NO:8119), SGSE.TGTPX$_n$GTPE.SGPG (SEQ ID NO:8120), SGSE.TGTPX$_n$GTPE.TPGS (SEQ ID NO:8121). SGSE.TGTPX$_n$SGSE.TGTP (SEQ ID NO:8122), SGSE.TGTPX$_n$GTPE.GSAP (SEQ ID NO:8123). SGSE.TGTPX$_n$EPSE.SATP (SEQ ID NO:8124), GTPE.GSAPX$_n$SGPE.SGPG (SEQ ID NO:8125), GTPE.GSAPX$_n$ATPE.SGPG (SEQ ID NO:8126), GTPE.GSAPX$_n$GTSE.SATP (SEQ ID NO:8127). GTPE.GSAPX$_n$TTPE.SGPG (SEQ ID NO:8128), GTPE.GSAPX$_n$STPE.SGPG (SEQ ID NO:8129).

GTPE.GSAPX$_n$GTPE.SGPG (SEQ ID NO:8130), GTPE.GSAPX$_n$GTPE.TPGS (SEQ ID NO:8131). GTPE.GSAPX$_n$SGSE.TGTP (SEQ ID NO:8132), GTPE.GSAPX$_n$GTPE.GSAP (SEQ ID NO:8133). GTPE.GSAPX$_n$EPSE.SATP (SEQ ID NO:8134). EPSE.SATPX$_n$SGPE.SGPG (SEQ ID NO:8136). EPSE.SATPX$_n$ATPE.SGPG (SEQ ID NO:8137). EPSE.SATPX$_n$GTSE.SATP (SEQ ID NO:8138). EPSE.SATPX$_n$TTPE.SGPG (SEQ ID NO:8139), EPSE.SATPX$_n$STPE.SGPG (SEQ ID NO:8140), EPSE.SATPX$_n$GTPE.SGPG (SEQ ID NO:8141), EPSE.SATPX$_n$GTPE.TPGS (SEQ ID NO:8142), EPSE.SATPX$_n$SGSE.TGTP (SEQ ID NO:8143), EPSE.SATPX$_n$GTPE.GSAP (SEQ ID NO:8144), or EPSE.SATPX$_n$EPSE.SATP (SEQ ID NO:8145), wherein each "." is a Glu-C cleavage site and n is any integer from 0 to 50. In some embodiments, the chimeric polypeptide comprises at least one of the following amino acid sequences:

```
                                  (SEQ ID NO: 8035)
          SGPE.SGPGX„ATPE.SGPG, (SEQ ID NO: 8048)
          ATPE.SGPGX„GTSE.SATP, (SEQ ID NO: 8050)
          ATPE.SGPGX„TTPE.SGPG, (SEQ ID NO: 8052)
          ATPE.SGPGX„STPE.SGPG, (SEQ ID NO: 8046)
          ATPE.SGPGX„ATPE.SGPG, (SEQ ID NO: 8054)
          ATPE.SGPGX„GTPE.SGPG, (SEQ ID NO: 8054)
          ATPE.SGPGX„GTPE.SGPG, (SEQ ID NO: 8046)
          ATPE.SGPGX„ATPE.SGPG, (SEQ ID NO: 8099)
          GTPE.SGPGX„GTPE.SGPG, (SEQ ID NO: 8097)
          GTPE.SGPGX„STPE.SGPG, (SEQ ID NO: 8095)
          GTPE.SGPGX„TTPE.SGPG, (SEQ ID NO: 8097)
          GTPE.SGPGX„STPE.SGPG, (SEQ ID NO: 8112)
          GTPE.TPGSX„SGSE.TGTP, (SEQ ID NO: 8135)
          GTPE.GSAPX„EPSE.SATP, (SEQ ID NO: 8054)
          ATPE.SGPGX„GTPE.SGPG, (SEQ ID NO: 8054)
          ATPE.SGPGX„GTPE.SGPG, (SEQ ID NO: 8046)
          ATPE.SGPGX„ATPE.SGPG, (SEQ ID NO: 8054)
          ATPE.SGPGX„GTPE.SGPG, (SEQ ID NO: 8073)
          TTPE.SGPGX„TTPE.SGPG,
```

```
                    -continued
              or (SEQ ID NO: 8085)
              STPE.SGPGX„STPE.SGPG,
``` wherein each "." is a Glu-C cleavage site and n is any integer from 0 to 30. In some embodiments, n is any integer from 1 to 20. In some embodiments, n is any integer from 5 to 15. In some embodiments, n is any integer from 3 to 7. In some embodiments, n is any integer from 5 to 10. In some embodiments, n is any integer from 5 to 10. In some embodiments, n is 9. In some embodiments, n is 4. In some embodiments, n is any integer from 5 to 15. In some embodiments, wherein $X_{11}$ is PGTGTSAT (SEQ ID NO:8146), PGSGPGT (SEQ ID NO:8147), PGTTPGTT (SEQ ID NO:8148), PGTPPTST (SEQ ID NO:8149), PGT-SPSAT (SEQ ID NO:8150), PGTGSAGT (SEQ ID NO:8151), PGTGGAGT (SEQ ID NO:8152), PGTSPGAT (SEQ ID NO:8153), PGTSGSGT (SEQ ID NO:8154), PGTSSAST (SEQ ID NO:8155), PGTGAGTT (SEQ ID NO:8156), PGTGSTST (SEQ ID NO:8157), GSEPATSG (SEQ ID NO:8158), APGTSTEP (SEQ ID NO:8159), PGTAGSGT (SEQ ID NO:8160), PGTSSGGT (SEQ ID NO:8161), PGTAGPAT (SEQ ID NO:8162), PGTPGTGT (SEQ ID NO:8163), PGTGGPTT (SEQ ID NO:8164), or PGTGSGST (SEQ ID NO:8165). In some embodiments, $X_n$ is TGTS (SEQ ID NO:8166), SGP, TTPG (SEQ ID NO:8167), TPPT (SEQ ID NO: 8168), TSPS (SEQ ID NO:8169), TGSA (SEQ ID NO:8170), TGGA (SEQ ID NO:8171), TSPG (SEQ ID NO: 8172), TSGS (SEQ ID NO:8173), TSSA (SEQ ID NO:8174), TGAG (SEQ ID NO:8175), TGST (SEQ ID NO:8176), EPAT (SEQ ID NO:8177), GTST (SEQ ID NO:8178), TAGS (SEQ ID NO: 8179), TSSG (SEQ ID NO:8180), TAGP (SEQ ID NO:8181), TPGT (SEQ ID NO:8182), TGGP (SEQ ID NO: 8183), or TGSG (SEQ ID NO:8184).

In some embodiments, barcodes are designed to have improved analytical properties. In some embodiments, such barcodes can be released with relatively modest concentrations of a non-mammalian protease such as Glu-C. This facilitates better detection, e.g., through LC/MS, and also allows measurement of peptides that are generated from the cleavable linker thereby allowing a measurement of cleavage products using, e.g., LC/MS.

In some embodiments of fusion proteins comprising an ELNN, the fusion protein has a single polypeptide chain, and the polypeptide chain comprises a barcode fragment that is at a position within the polypeptide chain that is from 10 to 200 amino acids or from 10 to 125 amino acids from the N-terminus or the C-terminus of the polypeptide chain. In some embodiments, a fusion protein (such as a paTCE) comprises a first ELNN and a second ELNN, the first ELNN is at the N-terminal side of the bispecific antibody domain, and the first barcode fragment is positioned within 200, 150, 100, or 50 amino acids of the N-terminus of the fusion protein. In some embodiments, the second ELNN is at the C-terminal side of the bispecific antibody domain, and the second barcode fragment is positioned within 200, 150, 100, or 50 amino acids of the C-terminus of the chimeric polypeptide.

In some embodiments, an ELNN further comprises one or more additional barcode fragments, wherein the one or more additional barcode fragments each differs in sequence and molecular weight from all other peptides fragments that are releasable from the polypeptide upon complete digestion of the polypeptide by the protease. In some embodiments, a barcoded ELNN comprises only one barcode fragment. In some embodiments, a barcoded ELNN comprises a set of barcode fragments, comprising a first barcode fragment, such as those described herein. In some embodiments, the set of barcode fragments comprises a second barcode fragment (or a further barcode fragment), such as those described herein. In some embodiments, the set of barcode fragments comprises a third barcode fragment, such as those described herein.

A set of barcode fragments fused within an N-terminal ELNN can be referred to as an N-terminal set of barcodes (an "N-terminal set"). A set of barcode fragments fused within a C-terminal ELNN can be referred to as a C-terminal set of barcodes (a "C-terminal set"). In some embodiments, the N-terminal set comprises a first barcode fragment and a second barcode fragment. In some embodiments, the N-terminal set further comprises a third barcode fragment. In some embodiments, the C-terminal set comprises a first barcode fragment and a second barcode fragment. In some embodiments, the C-terminal set further comprises a third barcode fragment. In some embodiments, the polypeptide comprises a set of barcode fragments that includes a first barcode fragment, a further (second) barcode fragment, and at least one additional barcode fragment, wherein each barcode fragment of the set of barcode fragments (1) is a portion of the second ELNN and (2) differs in sequence and molecular weight from all other peptides fragments that are releasable from the polypeptide upon complete digestion of the polypeptide by the protease.

Included herein is a mixture comprising a plurality of polypeptides of varying length; the mixture comprising a first set of polypeptides and a second set of polypeptides. In some embodiments, each polypeptide of the first set of polypeptides comprises a barcode fragment that (a) is releasable from the polypeptide by digestion with a protease and (b) has a sequence and molecular weight that differs from the sequence and molecular weight of all other fragments that are releasable from the first set of polypeptides. In some embodiments, the second set of polypeptides lack the barcode fragment of the first set of polypeptides (e.g., due to truncation). In some embodiments, both the first set of polypeptides and the second set of polypeptides each comprise a reference fragment that (a) is common to the first set of polypeptides and the second set of polypeptides and (b) releasable by digestion with the protease. In some embodiments, the ratio of the first set of polypeptides to polypeptides comprising the reference fragment is greater than 0.70. In some embodiments, the ratio of the first set of polypeptides to polypeptides comprising the reference fragment is greater than 0.80, 0.90, 0.95, or 0.98. In some embodiments, the reference fragment occurs no more than once in each polypeptide of the first set of polypeptides and the second set of polypeptides. In some embodiments, the protease is a protease that cleaves on the C-terminal side of glutamic acid residues. In some embodiments, the protease is a Glu-C protease. In some embodiments, the protease is not trypsin. In some embodiments, the polypeptides of varying lengths comprise polypeptides comprising at least one ELNN, such as any described herein. In some embodiments, the first set of polypeptides comprises a full-length polypeptide, wherein the barcode fragment is a portion of the full-length polypeptide. In some embodiments, the full-length polypeptide is a (fusion) polypeptide, such as any described hereinabove or described anywhere else herein. In some embodiments, the polypeptides of varying lengths in a mixture differ from one another due to N-terminal truncation, C-terminal truncation, or both N- and C-terminal truncation of a full-length polypeptide. In some embodiments, the first set of polypeptides and the second set of polypeptides may differ in one or more pharmacological properties.

The present disclosure also provides methods for assessing, in a mixture comprising polypeptides of varying length, a relative amount of a first set of polypeptides in the mixture to a second set of polypeptides in the mixture, wherein (1) each polypeptide of the first set of polypeptides shares a barcode fragment that occurs once and only once in the polypeptide and (2) each polypeptide of the second set of polypeptides lacks the barcode fragment that is shared by polypeptides of the first set, wherein individual polypeptides of both the first of polypeptides and the second set of polypeptides each comprises a reference fragment. In some embodiments, the methods comprise contacting the mixture with a protease to produce a plurality of proteolytic fragments that result from cleavage of the first set of polypeptides and the second set of polypeptides, wherein the plurality of proteolytic fragments comprise a plurality of reference fragments, and a plurality of barcode fragments. In some embodiments, the methods can further comprise determining a ratio of the amount of barcode fragments to the amount of reference fragments, thereby assessing the relative amounts of the first set of polypeptides to the second set of polypeptides. In some embodiments, the barcode fragment occurs no more than once in each polypeptide of the first set of polypeptides. In some embodiments, the reference fragment occurs no more than once in each polypeptide of the first set of polypeptides and the second set of polypeptides. In some embodiments, the plurality of proteolytic fragments comprises a plurality of reference fragments, and a plurality of barcode fragments. In some embodiments, the protease cleaves the first and second sets of polypeptides (or the polypeptides of varying length) on the C-terminal side of glutamic acid residues that are not followed by a proline residue. In some embodiments, the protease is a Glu-C protease. In some embodiments, the protease is not trypsin. In some embodiments, the step of determining a ratio of the amount of barcode fragments to the amount of reference fragments comprises identifying barcode fragments and reference fragments from the mixture after it has been contacted with the protease. In some embodiments, the barcode fragments and the reference fragments are identified based on their respective masses. In some embodiments, the barcode fragments and the reference fragments are identified via mass spectrometry.

In some embodiments, the barcode fragments and reference fragments are identified via liquid chromatography-mass spectrometry (LC-MS). In some embodiments, the step of determining a ratio of the barcode fragments to the reference fragments comprises isobaric labeling. In some embodiments, the step of determining a ratio of the barcode fragments to the reference fragments comprises spiking the mixture with one or both of an isotope-labeled reference fragment and an isotope labeled barcode fragment. In some embodiments, the polypeptides of varying lengths comprise polypeptides that comprise at least one ELNN, as described hereinabove or described anywhere else herein. In some embodiments, the ELNN is characterized in that (i) it comprises at least 100, or at least 150 amino acids; (ii) at least 90% of the amino acid residues of the ELNN are glycine (G), alanine (A), serine(S), threonine (T), glutamate (E) or proline (P); and (iii) it comprises at least 4 different types of amino acids that are G, A. S. T. E, or P. In some embodiments, the barcode fragment, when present, is a portion of the ELNN. In some embodiments, the mixture of polypeptides of varying lengths comprises a polypeptide as any described hereinabove or described anywhere else herein. In some embodiments, the polypeptides of varying length comprise a full-length polypeptide and truncated fragments thereof. In some embodiments, the polypeptides of varying length consist essentially of the full-length polypeptide and truncated fragments thereof. In some embodiments, the polypeptides of varying lengths in a mixture differ from one another due to N-terminal truncation, C-terminal truncation, or both N- and C-terminal truncation of a full-length polypeptide. In some embodiments, the full-length polypeptide is a polypeptide as described hereinabove or described anywhere else herein. In some embodiments, the ratio of the amount of barcode fragments to reference fragments is greater than 0.50, 0.60, 0.70, 0.80, 0.90, 0.95, 0.98, or 0.99.

Isobaric Labeling-Based Quantification of Peptides

In some embodiments, isobaric labeling can be used for determining a ratio of the barcode fragments to the reference fragments. Isobaric labeling is a mass spectrometry strategy used in quantitative proteomics, wherein peptides or proteins (or portions thereof) are labeled with various chemical groups that are isobaric (identical in mass) but vary in terms of distribution of heavy isotopes around their structure. In some embodiments, these tags, commonly referred to as tandem mass tags, are designed so that the mass tag is cleaved at a specific linker region upon high-energy collision-induced dissociation (CID) during tandem mass spectrometry, thereby yielding reporter ions of different masses. Some of the most common isobaric tags are amine-reactive tags.

Exemplary Barcoded ELNN Polypeptides

Included herein are ELNNs comprising barcode fragments that are portions of the ELNNs.

Amino acid sequences of exemplary barcoded ELNNs, containing one barcode (e.g., SEQ ID NOs: 8002-8003, 8005-8009, and 8013-8022), or two barcodes (e.g., SEQ ID NOS: 8001, 8004, and 8012), or three barcodes (e.g., SEQ ID NO: 8011), are illustrated in Table 3a. In some embodiments, among these exemplary barcoded ELNNs, 12 (SEQ ID NOs: 8001-8003, 8008-8009, 8011, 8015-8019, and 8022) are to be fused to a biologically-active protein (such as a TCE) at the C-terminal of the biologically-active protein, and 10 (SEQ ID NOS: 8004-8007, 8010, 8012-8014, 8020, and 8021) are to be fused at the N-terminal of the biologically-active protein. In some embodiments, the ELNN has at least 90%, at least 92%, at least 95%, at least 98%, at least 99% or 100% sequence identity to a sequence identified herein by SEQ ID NOs: 8001-8022 in Table 3a.

TABLE 3a

| | | | Exemplary Barcoded ELNNs | | |
|---|---|---|---|---|
| SEQ ID NO. | ELNN Type | # of Barcode(s) | Amino Acid Sequence | Total # of AAs |
| 8001 | C-terminal ELNN | 2 | PGSPAGSPTSTEEGTSESATPESGPGTSTEPSEGSAPGSPAGS PTSTEEGTSTEPSEGSAPGTSTEPSEGSAPGTSESATPESGPG SEPATSGSETPGSEPATSGSETPGSPAGSPTSTEEGTSESATP | 864 |

TABLE 3a-continued

| Exemplary Barcoded ELNNs | | | | |
|---|---|---|---|---|
| SEQ ID NO. | ELNN Type | # of Barcode(s) | Amino Acid Sequence | Total # of AAs |
| | | | ESGPGTSTEPSEGSAPGTSTEPSEGSAPGSPAGSPTSTEEGTS TEPSEGSAPGTSTEPSEGSAPGTSESATPESGPGTSTEPSEGS APGTSESATPESGPGSEPATSGSETPGTSTEPSEGSAPGTSTE PSEGSAPGTSESATPESGPGTSESATPESGPGSPAGSPTSTEE GTSESATPESGPGSEPATSGSETPGTSESATPESGPGTSTEPS EGSAPGTSTEPSEGSAPGTSTEPSEGSAPGTSTEPSEGSAPGT STEPSEGSAPGTSTEPSEGSAPGSPAGSPTSTEEGTSTEPSEG SAPGTSESATPESGPGSEPATSGSETPGTSESATPESGPGSEP ATSGSETPGTSESATPESGPGTSTEPSEGSAPGTSESATPESG PGSPAGSPTSTEEGSPAGSPTSTEEGSPAGSPTSTEEGTSESA TPESGPGTSTEPSEGSAPGTSESATPESGPGSEPATSGSETPG TSESATPESGPGSEPATSGSETPGTSESATPESGPGTSTEPSE GSAPGSPAGSPTSTEEGTSESATPESGPGSEPATSGSETPGTS ESATPESGPGSPAGSPTSTEEGSPAGSPTSTEEGTSTEPSEGS APGTSESATPESGPGTSESATPESGPGftabTSESATPESGPG SEPATSGPTESGSEPATSGSETPGSPAGSPTSTEEGTSTEPSE GSAPGTESTPSEGSAPGSEPATSGSETPGTSESATPESGPGTS TEPSEGSAPGEPEA | |
| 8002 | C-terminal ELNN | 1 | PGSPAGSPTSTEEGTSESATPESGPGTSTEPSEGSAPGSPAGS PTSTEEGTSTEPSEGSAPGTSTEPSEGSAPGTSESATPESGPG SEPATSGSETPGSEPATSGSETPGSPAGSPTSTEEGTSESATP ESGPGTSTEPSEGSAPGTSTEPSEGSAPGSPAGSPTSTEEGTS TEPSEGSAPGTSTEPSEGSAPGTSESATPESGPGTSTEPSEGS APGTSESATPESGPGSEPATSGSETPGTSTEPSEGSAPGTSTE PSEGSAPGTSESATPESGPGTSESATPESGPGSPAGSPTSTEE GTSESATPESGPGSEPATSGSETPGTSESATPESGPGTSTEPS EGSAPGTSTEPSEGSAPGTSTEPSEGSAPGTSTEPSEGSAPGT STEPSEGSAPGTSTEPSEGSAPGSPAGSPTSTEEGTSTEPSEG SAPGTSESATPESGPGSEPATSGSETPGTSESATPESGPGSEP ATSGSETPGTSESATPESGPGTSTEPSEGSAPGTSESATPESG PGSPAGSPTSTEEGSPAGSPTSTEEGSPAGSPTSTEEGTSESA TPESGPGTSTEPSEGSAPGTSESATPESGPGSEPATSGSETPG TSESATPESGPGSEPATSGSETPGTSESATPESGPGTSTEPSE GSAPGSPAGSPTSTEEGTSESATPESGPGSEPATSGSETPGTS ESATPESGPGSPAGSPTSTEEGSPAGSPTSTEEGTSTEPSEGS APGTSESATPESGPGTSESATPESGPGSEPA TSGPTESGSEPATSGSETPGSPAGSPTSTEEGTSTEPSEGSAP GTSTEPSEGSAPGSEPATSGSETPGTSESATPESGPGTSTEPS EGSAPGEPEA | 864 |
| 8003 | C-terminal ELNN | 1 | PGSPAGSPTSTEEGTSESATPESGPGTSTEPSEGSAPGSPAGS PTSTEEGTSTEPSEGSAPGTSTEPSEGSAPGTSESATPESGPG SEPATSGSETPGSEPATSGSETPGSPAGSPTSTEEGTSESATP ESGPGTSTEPSEGSAPGTSTEPSEGSAPGSPAGSPTSTEEGTS TEPSEGSAPGTSTEPSEGSAPGTSESATPESGPGTSTEPSEGS APGTSESATPESGPGSEPATSGSETPGTSTEPSEGSAPGTSTE PSEGSAPGTSESATPESGPGTSESATPESGPGSPAGSPTSTEE GTSESATPESGPGSEPATSGSETPGTSESATPESGPGTSTEPS EGSAPGTSTEPSEGSAPGTSTEPSEGSAPGTSTEPSEGSAPGT STEPSEGSAPGTSTEPSEGSAPGSPAGSPTSTEEGTSTEPSEG SAPGTSESATPESGPGSEPATSGSETPGTSESATPESGPGSEP ATSGSETPGTSESATPESGPGTSTEPSEGSAPGTSESATPESG PGSPAGSPTSTEEGSPAGSPTSTEEGSPAGSPTSTEEGTSESA TPESGPGTSTEPSEGSAPGTSESATPESGPGSEPATSGSETPG TSESATPESGPGSEPATSGSETPGTSESATPESGPGTSTEPSE GSAPGSPAGSPTSTEEGTSESATPESGPGSEPATSGSETPGTS ESATPESGPGSPAGSPTSTEEGSPAGSPTSTEEGTSTEPSEGS APGTSESATPESGPGTSESATPESGPGTSESATPESGPGSEPA TSGSETPGSEPATSGSETPGSPAGSPTSTEEGTSTEPSEGSAP GTESTPSEGSAPGSEPATSGSETPGTSESATPESGPGTSTEPS EGSAPGEPEA | 864 |
| 8004 | N-terminal ELNN | 2 | ASSPAGSPTSTESGTSESATPESGPGTSETEPSEGSAPGTSESA TPESGPGSEPATSGSETPGTSESATPESGPGSTPAESGSETP GTSESATPESGPGTSTEPSEGSAPGSPAGSPTSTEEGTSESAT PESGPGESPATSGSTPEGTSESATPESGPGSPAGSPTSTEEGS PAGSPTSTEEGTSTEPSEGSAPGTSESATPESGPGTSESATPE SGPGTSESATPESGPGSEPATSGSETPGSEPATSGSETPGSPA GSPTSTEEGTSTEPSEGSAPGTSTEPSEGSAPGGSAP | 288 |
| 8005 | N-terminal ELNN | 1 | ASSPAGSPTSTESGTSESATPESGPGTSTEPSEGSAPGTSESA TPESGPGSEPATSGSETPGTSESATPESGPGSEPATSGSETPG TSESATPESGPGTSTEPSEGSAPGSPAGSPTSTEEGTSESATP ESGPGESPATSGSTPEGTSESATPESGPGSPAGSPTSTEEGSP | 288 |

TABLE 3a-continued

Exemplary Barcoded ELNNs

| SEQ ID NO. | ELNN Type | # of Barcode(s) | Amino Acid Sequence | Total # of AAs |
|---|---|---|---|---|
| | | | AGSPTSTEEGTSTEPSEGSAPGTSESATPESGPGTSESATPES GPGTSESATPESGPGSEPATSGSETPGSEPATSGSETPGSPAG SPTSTEEGTSTEPSEGSAPGTSTEPSEGSAPGGSAP | |
| 8006 | N-terminal ELNN | 1 | ASSPAGSPTSTESGTSESATPESGPGTSTEPSEGSAPGTSESA TPESGPGSEPATSGSETPGTSESATPESGPGSTPAESGSETP GTSESATPESGPGTSTEPSEGSAPGSPAGSPTSTEEGTSESAT PESGPGEEPATSGSTPEGTSESATPESGPGSPAGSPTSTEEGS PAGSPTSTEEGTSTEPSEGSAPGTSESATPESGPGTSESATPE SGPGTSESATPESGPGSEPATSGSETPGSEPATSGSETPGSPA GSPTSTEEGTSTEPSEGSAPGTSTEPSEGSAPGGSAP | 288 |
| 8007 | N-terminal ELNN | 1 | ASSPAGSPTSTESGTSESATPESGPGTSTEPSEGSAPGTSESA TPESGPGSEPATSGSETPGTSESATPESGPGSTPAESGSETP GTSESATPESGPGTSTEPSEGSAPGSP̄AGSPTSTEEGTSESAT PESGPGSEPATSGSETPGTSESATPESGPGSPAGSPTSTEEGS PAGSPTSTEEGTSTEPSEGSAPGTSESATPESGPGTSESATPE SGPGTSESATPESGPGSEPATSGSETPGSEPATSGSETPGSPA GSPTSTEEGTSTEPSEGSAPGTSTEPSEGSAPGGSAP | 288 |
| 8008 | C-terminal ELNN | 1 | PGSPAGSPTSTEEGTSESATPESGPGTSTEPSEGSAPGSPAGS PTSTEEGTSTEPSEGSAPGTSTEPSEGSAPGTSESATPESGPG SEPATSGSETPGSEPATSGSETPGSPAGSPTSTEEGTSESATP ESGPGTSTEPSEGSAPGTSTEPSEGSAPGSPAGSPTSTEEGTS TEPSEGSAPGTSTEPSEGSAPGTSESATPESGPGTSTEPSEGS APGTSESATPESGPGSEPATSGSETPGTSTEPSEGSAPGTSTE PSEGSAPGTSESATPESGPGTSESATPESGPGSPAGSPTSTEE GTSESATPESGPGSEPATSGSETPGTSESATPESGPGTSTEPS EGSAPGTSTEPSEGSAPGTSTEPSEGSAPGTSTEPSEGSAPGT STEPSEGSAPGTSTEPSEGSAPGSPAGSPTSTEEGTSTEPSEG SAPGTSESATPESGPGSEPATSGSETPGTSESATPESGPGSEP ATSGSETPGTSESATPESGPGTSTEPSEGSAPGTSESATPESG PGSPAGSPTSTEEGSPAGSPTSTEEGSPAGSPTSTEEGTSESA TPESGPGTSTEPSEGSAPGTSESATPESGPGSEPATSGSETPG TSESATPESGPGSEPATSGSETPGTSESATPESGPGTSTEPSE GSAPGSPAGSPTSTEEGTSESATPESGPGSEPATSGSETPGTS ESATPESGPGSPAGSPTSTEEGSPAGSPTSTEEGTSTEPSEGS APGTSESATPESGPGTSESATPESGPGTSESATPESGPGSEPA TSGSETPGSEPATSGSETPGSPAGSPTSTEEGTSTEPSEGSAP GTESTPSEGSAPGSEPATSGSETPGTSESATPESGPGTSTEPS EGSAPG | 864 |
| 8009 | C-terminal ELNN | 1 | PGSPAGSPTSTEEGTSESATPESGPGSEPATSGSETPGTSESA TPESGPGTSTEPSEGSAPGTSTEPSEGSAPGTSTEPSEGSAPG TSTEPSEGSAPGTSTEPSEGSAPGSPAGSPTSTEEGSPAGSPT STEEGTSTEPSEGSAPGTSESATPESGPGSEPATSGSETPGTS ESATPESGPGSEPATSGSETPGTSESATPESGPGTSTEPSEGS APGTSESATPESGPGSPAGSPTSTEEGSPAGSPTSTEEGSPAG SPTSTEEGTSESATPESGPGTSTEPSEGSAPGTSESATPESGP GSEPATSGSETPGTSESATPESGPGSEPATSGSETPGTSESAT PESGPGTSTEPSEGSAPGSPAGSPTSTEEGTSESATPESGPGS EPATSGSETPGTSESATPESGPGSPAGSPTSTEEGSPAGSPTS TEEGTSTEPSEGSAPGTSESATPESGPGTSESATPESGPGTSE SATPESGPGSEPATSGSETPGSEPATSGSETPGSPAGSPTSTE EGTSTEPSEGSAPGTESTPSEGSAPGSEPATSGSETPGTSES ATPESGPGTSTEPSEGSAPG | 576 |
| 8010 | N-terminal ELNN | 2 | SAGSPGSPAGSPTSTEEGTSESATPESGPGTSTEPSEGSAPGS PAGSPTSTEEGTSTEPSEGSAPGTSTEPSEGSAPGTSESATPE SGPGSTPAESGSETPGSEPATSGSETPGSPAGSPTSTEEGTSE ESATPESGPGTSTEPSEGSAPGTSTEPSEGSAPGSPAGSPTST EEGTSTEPSEGSAPGTSTEPSEGSAPGTSESATPESGPGTSTE PSEGSAPGTSESATPESGPGSEPATSGSTETPGTSTEPSEGSA PGTSTEPSEGSAPGTSESATPĒSḠPGTSESATPESGPGSPAGS PTSTEEGTSESATPESGPGSEPATSGSETPGTSESATPESGPG TSTEPSEGSAPGTSTEPSEGSAPGTSTEPSEGSAPGTSTEPSE GSAPGTSTEPSEGSAPGTSTEPSEGSAPGSPAGSPTSTEEGTS TEPSEGSAPGTSESATPESGPGSEPATSGSETPGTSESATPES GPGSEPATSGSETPGTSESATPESGPGTSTEPSEGSAPGTSES ATPESGPGSPAGSPTSTEEGSPAGSPTSTEEGSPAGSPTSTEE GTSESATPESGPGTSTEPSEGSAPGTSESATPESGPGSEPATS GSETPGTSESATPESGPGSEPATSGSETPGTSESATPESGPGT STEPSEGSAPGSPAGSPTSTEEGTSESATPESGPGSEPATSGS ETPGTSESATPESGPGSPAGSPTSTEEGSPAGSPTSTEEGTST EPSEGSAPGTSESATPESGPGTSESATPESGPGTSESATPESG | 1152 |

TABLE 3a-continued

| | | | Exemplary Barcoded ELNNs | |
|---|---|---|---|---|
| SEQ ID NO. | ELNN Type | # of Barcode(s) | Amino Acid Sequence | Total # of AAs |
| | | | PGSEPATSGSETPGSEPATSGSETPGSPAGSPTSTEEGTSTEP SEGSAPGTSTEPSEGSAPGSEPATSGSETPGTSESATPESGPG TSTEPSEGSAPGSPAGSPTSTEEGTSESATPESGPGTSTEPSE GSAPGSPAGSPTSTEEGTSTEPSEGSAPGTSTEPSEGSAPGTS ESATPESGPGSEPATSGSETPGSEPATSGSETPGSPAGSPTST EEGTSESATPESGPGTSTEPSEGSAPGTSTEPSEGSAPGSPAG SPTSTEEGTSTEPSEGSAPGTSTEPSEGSAPGTSESATPESGP GTSTEPSEGSAPGTSESATPESGPGSEPATSGSETPGTSTEPS EGSAPGTSTEPSEGSAPGTSESATPESGPGTSESAS | |
| 8011 | C-terminal ELNN | 3 | SAGSPGSPAGSPTSTEEGTSESATPESGPGTSTEPSEGSAPGS PAGSPTSTEEGTSTEPSEGSAPGTSTEPSEGSAPGTSESATPE SGPGSEPATSGSETPGSEPATSGSETPGSPAGSPTSTEEGTSE SATPESGPGTSTEPSEGSAPGTSTEPSEGSAPGSPAGSPTSTE EGTSTEPSEGSAPGTSTEPSEGSAPGTSESATPESGPGTSTEP SEGSAPGTSESATPESGPGSEPATSGSETPGTSTEPSEGSAPG TSTEPSEGSAPGTSESATPESGPGTSESATPESGPGSPAGSPT STEEGTSESATPESGPGSEPATSGSETPGTSESATPESGPGTS TEPSEGSAPGTSTEPSEGSAPGTSTEPSEGSAPGTSTEPSEGS APGTSTEPSEGSAPGTSTEPSEGSAPGSPAGSPTSTEEGTSTE PSEGSAPGTSESATPESGPGSEPATSGSETPGTSESATPESGP GSEPATSGSETPGTSESATPESGPGTSTEPSEGSAPGTSESAT PESGPGSPAGSPTSTEEGSPAGSPTSTEEGSPAGSPTSTEEGT SESATPESGPGTSTEPSEGSAPGTSESATPESGPGSEPATSGS ETPGTSESATPESGPGSEPATSGSETPGTSESATPESGPGTST EPSEGSAPGSPAGSPTSTEEGTSESATPESGPGSEPATSGSET PGTSESATPESGPGSPAGSPTSTEEGSPAGSPTSTEEGTSTEP SEGSAPGTSESATPESGPGTSESATPESGPGTSESATPESGPG SEPATSGSETPGSEPATSGSETPGSPAGSPTSTEEGTSTEPSE GSAPGTSTEPSEGSAPGSEPATSGSETPGTSESATPESGPGTS TEPSEGSAPGSPAGSPTSTEEGTSESATPESGPGTSTEPSEGS APGSPAGSPTSTEEGTSTEPSEGSAPGTSTEPSEGSAPGTSES ATPESGPGSEPATSGSETPGSEPATSGSTETPGSPAGSPTSTE EGTSESATPESGPGTSTEPSEGSAPGTSTEPSEGSAPGSPAGS PTSTEEGTSTEPSEGSAPGTATESPEGSAPGTSESATPESGP GTSTEPSEGSAPGTSAESATPESGPGSEPATSGSETPGTSTE PSEGSAPGTSTEPSEGSAPGTSESATPESGPGTSESAS | 1152 |
| 8012 | N-terminal ELNN | 2 | GSPAGSPTSTEEGTSESATPESGPGTSTEPSEGSAPGSPAGSP TSTEEGTSTEPSEGSAPGTSTEPSEGSAPATSESATPESGPGS EPATSGSETPGSEPATSGSETPGSPAGSPTSTEEGTSESASPE SGPGTSTEPSEGSAPGTSTEPSEGSAPGSPAGSPTSTEEGTST EPSEGSAPGTSTEPSEGSAPGTSESATPESGPGTSTEPSEGSA PGTSESATPESGPGSEPATSGSETPGTSTEPSEGSAPGTSTEP SEGSAPGTSESATPESGPGTSESATPESGPGSPAGSPTSTEEG TSESATPESGPGSEPATSGSETPGTSESATPESGPGTSTEPSE GSAPGTSTEPSEGSAPGTSTEPSEGSAPGTSTEPSEGSAPGTS TEPSEGSAPGTSTEPSEGSAPGSPAGSPTSTEEGTSTEPSEGS APGTSESATPESGPGSEPATSGSETPGTSESATPESGPGSEPA TSGSETPGTSESATPESGPGTSTEPSEGSAPGTSESATPESGP GSPAGSPTSTEEGSPAGSPTSTEEGSPAGSPTSTEEGTSESAT PESGPGTSTEPSEGSAPGTSESATPESGPGSEPATSGSETPGT SESATPESGPGSEPATSGSETPGTSESATPESGPGTSTEPSEG SAPGSPAGSPTSTEEGTSESATPESGPGSEPATSGSETPGTSE SATPESGPGSPAGSPTSTEEGSPAGSPTSTEEGTSTEPSEGSA PGTSESATPESGPGTSESATPESGPGTSESATPESGPGSEPAT SGSETPGSEPATSGSETPGSPAGSPTSTEEGTSTEPSEGSAPG TSTEPSEGSAPGSEPATSGSETPGTSESATPESGPGTSTEPSE GSAP | 864 |
| 8013 | N-terminal ELNN | 1 | GSPAGSPTSTEEGTSESATPESGPGTSTEPSEGSAPGSPAGSP TSTEEGTSTEPSEGSAPGTSTEPSEGSAPGTSESATPESGPGS ESATSGSETPGSEPATSGSETPGSPAGSPTSTEEGTSESATPE SGPGTSTEPSEGSAPGTSTEPSEGSAPGSPAGSPTSTEEGTST EPSEGSAPGTSTEPSEGSAPGTSESATPESGPGTSTEPSEGSA PGTSESATPESGPGSEPATSGSETPGTSTEPSEGSAPGTSTEP SEGSAPGTSESATPESGPGTSESATPESGPGSPAGSPTSTEEG TSESATPESGPGSEPATSGSETPGTSESATPESGPGTSTEPSE GSAPGTSTEPSEGSAPGTSTEPSEGSAPGTSTEPSEGSAPGTS TEPSEGSAPGTSTEPSEGSAPGSPAGSPTSTEEGTSTEPSEGS APGTSESATPESGPGSEPATSGSETPGTSESATPESGPGSEPA TSGSETPGTSESATPESGPGTSTEPSEGSAPGTSESATPESGP GSPAGSPTSTEEGSPAGSPTSTEEGSPAGSPTSTEEGTSESAT PESGPGTSTEPSEGSAPGTSESATPESGPGSEPATSGSETPGT SESATPESGPGSEPATSGSETPGTSESATPESGPGTSTEPSEG | 864 |

TABLE 3a-continued

Exemplary Barcoded ELNNs

| SEQ ID NO. | ELNN Type | # of Barcode(s) | Amino Acid Sequence | Total # of AAs |
|---|---|---|---|---|
| | | | SAPGSPAGSPTSTEEGTSESATPESGPGSEPATSGSETPGTSE SATPESGPGSPAGSPTSTEEGSPAGSPTSTEEGTSTEPSEGSA PGTSESATPESGPGTSESATPESGPGTSESATPESGPGSEPAT SGSETPGSEPATSGSETPGSPAGSPTSTEEGTSTEPSEGSAPG TSTEPSEGSAPGSEPATSGSETPGTSESATPESGPGTSTEPSE GSAP | |
| 8014 | N-terminal ELNN | 1 | SPAGSPTSTESGTSESATPESGPGTSTEPSEGSAPGTSESATP ESGPGSEPATSGSETPGTSESATPESGPGSTPAESGSETPGT SESATPESGPGTSTEPSEGSAPGSPAGSPTSTEEGTSESATPE SGPGSEPATSGSETPGTSESATPESGPGSPAGSPTSTEEGSPA GSPTSTEEGTSTEPSEGSAPGTSESATPESGPGTSESATPESG PGTSESATPESGPGSEPATSGSETPGSEPATSGSETPGSPAGS PTSTEEGTSTEPSEGSAPGTSTEPSEGSAPGGSAP | 292 |
| 8015 | C-terminal ELNN | 1 | PGSPAGSPTSTEEGTSESATPESGPGSEPATSGSETPGTSESA TPESGPGTSTEPSEGSAPGTSTEPSEGSAPGTSTEPSEGSAPG TSTEPSEGSAPGTSTEPSEGSAPGTSTEPSEGSAPGSPAGSPT STEEGTSTEPSEGSAPGTSESATPESGPGSEPATSGSETPGTS ESATPESGPGSEPATSGSETPGTSESATPESGPGTSTEPSEGS APGTSESATPESGPGSPAGSPTSTEEGSPAGSPTSTEEGSPAG SPTSTEEGTSESATPESGPGTSTEPSEGSAPGTSESATPESGP GSEPATSGSETPGTSESATPESGPGSEPATSGSETPGTSESAT PESGPGTSTEPSEGSAPGSPAGSPTSTEEGTSESATPESGPGS EPATSGSETPGTSESATPESGPGSPAGSPTSTEEGSPAGSPTS TEEGTSTEPSEGSAPGTSESATPESGPGTSESATPESGPGTSE SATPESGPGSEPATSGSETPGSEPATSGSETPGSPAGSPTSTE EGTSTEPSEGSAPGTESTPSEGSAPGSEPATSGSETPGTSES ATPESGPGTSTEPSEGSAPGEPEA | 582 |
| 8016 | C-terminal ELNN | 1 | TPESGPGTSESATPESGPGSPAGSPTSTEEGTSESATPESGPG SEPATSGSETPGTSESATPESGPGTSTEPSEGSAPGTSTEPSE GSAPGTSTEPSEGSAPGTSTEPSEGSAPGTSTEPSEGSAPGTS TEPSEGSAPGSPAGSPTSTEEGTSTEPSEGSAPGTSESATPES GPGSEPATSGSETPGTSESATPESGPGSEPATSGSETPGTSES ATPESGPGTSTEPSEGSAPGTSESATPESGPGSPAGSPTSTEE GSPAGSPTSTEEGSPAGSPTSTEEGTSESATPESGPGTSTEPS EGSAPGTSESATPESGPGSEPATSGSETPGTSESATPESGPGS EPATSGSETPGTSESATPESGPGTSTEPSEGSAPGSPAGSPTS TEEGTSESATPESGPGSEPATSGSETPGTSESATPESGPGSPA GSPTSTEEGSPAGSPTSTEEGTSTEPSEGSAPGTSESATPESG PGTSESATPESGPGSEPATSGSETPGSESAT SGSETPGSPAGSPTSTEEGTSTEPSEGSAPGTSTEPSEGSAPG SEPATSGSETPGTSESA | 576 |
| 8017 | C-terminal ELNN | 1 | GTSTEPSEGSAPGTSESATPESGPGSEPATSGSETPGSEPATS GSETPGSPAGSPTSTEEGTSESATPESGPGTSTEPSEGSAPGT STEPSEGSAPGSPAGSPTSTEEGTSTEPSEGSAPGTSTEPSEG SAPGTSESATPESGPGTSTEPSEGSAPGTSESATPESGPGSEP ATSGSETPGTSTEPSEGSAPGTSTEPSEGSAPGTSESATPESG PGTSESATPESGPGSPAGSPTSTEEGTSESATPESGPGSEPAT SGSETPGTSESATPESGPGTSTEPSEGSAPGTSTEPSEGSAPG TSTEPSEGSAPGTSTEPSEGSAPGTSTEPSEGSAPGTSTEPSE GSAPGSPAGSPTSTEEGTSTEPSEGSAPGTSESATPESGPGSE PATSGSETPGTSESATPESGPGSEPATSGSETPGTSESATPES GPGTSTEPSEGSAPGTSESASPESGPGSPAGSPTSTEEGSPAG SPTSTEEGSPAGSPTSTEEGTSESATPESGPGTSTEPSEGSAP GTSESATPESGPGSEPATSGSETPGTSESATPESGPGSEPATS GSETPGTSESATPESGP | 576 |
| 8018 | C-terminal ELNN | 1 | GSETPGSPAGSPTSTEEGTSESATPESGPGTSTEPSEGSAPGT STEPSEGSAPGSPAGSPTSTEEGTSTEPSEGSAPGTSTEPSEG SAPGTSESATPESGPGTSTEPSEGSAPGTSESATPESGPGSEP ATSGSETPGTSTEPSEGSAPGTSTEPSEGSAPGTSESATPESG PGTSESATPESGPGSPAGSPTSTEEGTSESATPESGPGSEPAT SGSETPGTSESATPESGPGTSTEPSEGSAPGTSTEPSEGSAPG TSTEPSEGSAPGTSTEPSEGSAPGTSTEPSEGSAPGTSTEPSE GSAPGSPAGSPTSTEEGTSTEPSEGSAPGTSESATPESGPGSE PATSGSETPGTSESATPESGPGSEPATSGSETPGTSESATPES GPGTSTEPSEGSAPGTSESATPESGPGSPAGSPTSTEEGSPAG SPTSTEEGTSESATPESGPGTSTEPSEGSAPGTSESATPESGPGSEPATSGSTETGTSESATPESGPGSEPAT SGSETPGTSESATPESGPGTSTEPSEGSAPGSPAGSPTSTEEG TSESATPESGPGSEPATS | 576 |

TABLE 3a-continued

Exemplary Barcoded ELNNs

| SEQ ID NO. | ELNN Type | # of Barcode(s) | Amino Acid Sequence | Total # of AAs |
|---|---|---|---|---|
| 8019 | C-terminal ELNN | 1 | EGSAPGTSTEPSEGSAPGTSESATPESGPGTSTEPSEGSAPGT SESATPESGPGSEPATSGSETPGTSTEPSEGSAPGTSTEPSEG SAPGTSESATPESGPGTSESATPESGPGSPAGSPTSTEEGTSE SATPESGPGSEPATSGSETPGTSESATPESGPGTSTEPSEGSA PGTSTEPSEGSAPGTSTEPSEGSAPGTSTEPSEGSAPGTSTEP SEGSAPGTSTEPSEGSAPGSPAGSPTSTEEGTSTEPSEGSAPG TSESATPESGPGSEPATSGSETPGTSESATPESGPGSEPATSG SETPGTSESATPESGPGTSTEPSEGSAPGTSESATPESGPGSP AGSPTSTEEGSPAGSPTSTEEGSPAGSPTSTEEGTSESATPES GPGTSTEPSEGSAPGTSESATPESGPGSEPATSGSETPGTSES ATPESGPGSEPATSGSETPGTSESASPESGPGTSTEPSEGSAP GSPAGSPTSTEEGTSESATPESGPGSEPATSGSETPGTSESAT PESGPGSPAGSPTSTEEGSPAGSPTSTEEGTSTEPSEGSAPGT SESATPESGPGTSESAT | 576 |
| 8020 | N-terminal ELNN | 1 | ASSPAGSPTSTESGTSESATPESGPGTSTEPSEGSAPGTSESA TPESGPGSEPATSGSETPGTSESATPESGPGSTPAESGSETPG TSESATPESGPGTSTEPSEGSAPGSPAGSPTSTEEGTSESATP ESGPGSEPATSGSETPGTSESATPESGPGSPAGSPTSTEEGSP AGSPTSTEEGTSTEPSEGSAPGTSESATPESGPGTSESATPES GPGTSESATPESGPGSEPATSGSETPGSEPATSGSETPGSPAG SPTSTEEGTSTEPSEGSAPGTSTEPSEGSAPGGSAP | 294 |
| 8021 | N-terminal ELNN | 1 | ASSATPESGPGTSTEPSEGSAPGTSESATPESGPGSGPGTSE SATPGTSESATPESGPGSEPATSGSETPGTSESATPESGPGTS TEPSEGSAPGSPAGSPTSTEEGTSESATPESGPGSEPATSGSE TPGTSESATPESGPGSPAGSPTSTEEGSPAGSPTSTEEGTSTE PSEGSAPGTSESATPESGPGTSESATPESGPGTSESATPESGP GSEPATSGSETPGSEPATSGSETPGSPAGSPTSTEEGTSTEPS EGSAPGTSTEPSEGSAPGSEPATSGSETPGTSESATP | 294 |
| 8022 | C-terminal ELNN | 1 | ATPESGPGTSESATPESGPGSPAGSPTSTEEGTSESATPESGP GSEPATSGSETPGTSESATPESGPGTSTEPSEGSAPGTSTEPS EGSAPGTSTEPSEGSAPGTSTEPSEGSAPGTSTEPSEGSAPGT STEPSEGSAPGSPAGSPTSTEEGTSTEPSEGSAPGTSESATPE SGPGSEPATSGSETPGTSESATPESGPGSEPATSGSETPGTSE SATPESGPGTSTEPSEGSAPGTSESATPESGPGSPAGSPTSTE EGSPAGSPTSTEEGTSESATPESGPGTSTEP SEGSAPGTSESATPESGPGSEPATSGSETPGTSESATPESGPG SEPATSGSETPGTSESATPESGPGTSTEPSEGSAPGSPAGSPT STEEGTSESATPESGPGSEPATSGSETPGTSESATPESGPGSP AGSPTSTEEGSPAGSPTSTEEGTSTEPSEGSAPGTSESATPES GPGTSESATPESGPGTSPSATPESGPGSEPATSGSETPGSEP ATSGSETPGSPAGSPTSTEEGTSTEPSEGSAPGTSTEPSEGSA PGSEPATSGSETPGTSESAGEPEA | 582 |

In some embodiments, a barcoded ELNN can be obtained by making one or more mutations to existing ELNN, such as any listed in Table 3b, according to one or more of the following criteria: to minimize the sequence change in the ELNN, to minimize the amino acid composition change in the ELNN, to substantially maintain the net charge of the ELNN, to substantially maintain (or improve) low immunogenicity of the ELNN, and to substantially maintain (or improve) the pharmacokinetic properties of the ELNN. In some embodiments, the ELNN sequence has at least 90%, at least 92%, at least 95%, at least 98%, at least 99%, or 100% sequence identity to any one of SEQ ID NOs: 601-659 listed in Table 3b. In some embodiments, the ELNN sequence, having at least 90% (e.g., at least 92%, at least 95%, at least 98%, or at least 99%) but less than 100% sequence identity to any of SEQ ID NOs: 601-659 listed in Table 3b, is obtained by one or more mutations (e.g., less than 10, less than 8, less than 6, less than 5, less than 4, less than 3, less than 2 mutations) of the corresponding sequence from Table 3b. In some embodiments, the one or more mutations comprise deletion of a glutamic acid residue, insertion of a glutamic acid residue, substitution of a glutamic acid residue, or substitution for a glutamic acid residue, or any combination thereof. In some embodiments, where the ELNN sequence differs from, but has at least 90% (e.g., at least 92%, at least 95%, at least 98%, or at least 99%) sequence identity to, any one of SEQ ID NOs: 601-659 listed in Table 3b, at least 80%, at least 90%, at least 95%, at least 97%, or about 100% of the difference between the ELNN sequence and the corresponding sequence of Table 3b involve deletion of a glutamic acid residue, insertion of a glutamic acid residue, substitution of a glutamic acid residue, or substitution for a glutamic acid residue, or any combination thereof. In some such embodiments, at least 80%, at least 90%, at least 95%, at least 97%, or about 100% of the difference between the ELNN sequence and the corresponding sequence of Table 3b involve a substitution of a glutamic acid residue, or a substitution for a glutamic acid residue, or both.

The "a substitution of a first amino acid," as used herein, refers to replacement of the first amino acid residue with a second amino acid residue, resulting in the second amino acid residue taking its place at the substitution position in the obtained sequence. For example, "a substitution of glutamic acid" refers to replacement of the glutamic acid (E) residue for a non-glutamic acid residue (e.g., serine(S)).

TABLE 3b

| | Exemplary Existing ELNNs for Engineering into Barcoded ELNN(s) | |
|---|---|---|
| ELNN Name | Amino Acid Sequence | SEQ ID NO |
| AE144 | GSEPATSGSETPGTSESATPESGPGSEPATSGSETPGSPAGSPTSTEEGTSTEPSEGS APGSEPATSGSETPGSEPATSGSETPGSEPATSGSETPGTSTEPSEGSAPGTSESATP ESGPGSEPATSGSETPGTSTEPSEGSAP | 601 |
| AE144_1A | SPAGSPTSTEEGTSESATPESGPGTSTEPSEGSAPGSPAGSPTSTEEGTSTEPSEGSAP GTSTEPSEGSAPGTSESATPESGPGSEPATSGSETPGSEPATSGSETPGSPAGSPTST EEGTSESATPESGPGTSTEPSEGSAPG | 602 |
| AE144_2A | TSTEPSEGSAPGSPAGSPTSTEEGTSTEPSEGSAPGTSTEPSEGSAPGTSESATPESGP GTSTEPSEGSAPGTSESATPESGPGSEPATSGSETPGTSTEPSEGSAPGTSTEPSEGS APGTSESATPESGPGTSESATPESGPG | 603 |
| AE144_2B | TSTEPSEGSAPGSPAGSPTSTEEGTSTEPSEGSAPGTSTEPSEGSAPGTSESATPESGP GTSTEPSEGSAPGTSESATPESGPGSEPATSGSETPGTSTEPSEGSAPGTSTEPSEGS APGTSESATPESGPGTSESATPESGPG | 604 |
| AE144_3A | SPAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGS APGSPAGSPTSTEEGTSTEPSEGSAPG | 605 |
| AE144_3B | SPAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGS APGSPAGSPTSTEEGTSTEPSEGSAPG | 606 |
| AE144_4A | TSESATPESGPGSEPATSGSETPGTSESATPESGPGSEPATSGSETPGTSESATPESGP GTSTEPSEGSAPGTSESATPESGPGSPAGSPTSTEEGSPAGSPTSTEEGSPAGSPTST EEGTSESATPESGPGTSTEPSEGSAPG | 607 |
| AE144_4B | TSESATPESGPGSEPATSGSETPGTSESATPESGPGSEPATSGSETPGTSESATPESGP GTSTEPSEGSAPGTSESATPESGPGSPAGSPTSTEEGSPAGSPTSTEEGSPAGSPTST EEGTSESATPESGPGTSTEPSEGSAPG | 608 |
| AE144_5A | TSESATPESGPGSEPATSGSETPGTSESATPESGPGSEPATSGSETPGTSESATPESGP GTSTEPSEGSAPGSPAGSPTSTEEGTSESATPESGPGSEPATSGSETPGTSESATPES GPGSPAGSPTSTEEGSPAGSPTSTEEG | 609 |
| AE144_6B | TSTEPSEGSAPGTSESATPESGPGTSESATPESGPGTSESATPESGPGSEPATSGSETP GSEPATSGSETPGSPAGSPTSTEEGTSTEPSEGSAPGTSTEPSEGSAPGSEPATSGSE TPGTSESATPESGPGTSTEPSEGSAPG | 610 |
| AE288_1 | GTSESATPESGPGSEPATSGSETPGTSESATPESGPGSEPATSGSETPGTSESATPES GPGTSTEPSEGSAPGSPAGSPTSTEEGTSESATPESGPGSEPATSGSETPGTSESATP ESGPGSPAGSPTSTEEGSPAGSPTSTEEGTSTEPSEGSAPGTSESATPESGPGTSESA TPESGPGTSESATPESGPGSEPATSGSETPGSEPATSGSETPGSPAGSPTSTEEGTST EPSEGSAPGTSTEPSEGSAPGSEPATSGSETPGTSESATPESGPGTSTEPSEGSAP | 611 |
| AE288_2 | GSPAGSPTSTEEGTSESATPESGPGSEPATSGSETPGTSESATPESGPGTSTEPSEGS APGTSTEPSEGSAPGTSTEPSEGSAPGTSTEPSEGSAPGTSTEPSEGSAPGTSTEPSE GSAPGSPAGSPTSTEEGTSTEPSEGSAPGTSESATPESGPGSEPATSGSETPGTSESA TPESGPGSEPATSGSETPGTSESATPESGPGTSTEPSEGSAPGTSESATPESGPGSPA GSPTSTEEGSPAGSPTSTEEGSPAGSPTSTEEGTSESATPESGPGTSTEPSEGSAP | 612 |
| AE576 | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAP | 613 |
| AE624 | MAEPAGSPTSTEEGTPGSGTASSSPGSSTPSGATGSPGASPGTSSTGSPGSPAGSPTS TEEGTSESATPESGPGTSTEPSEGSAPGSPAGSPTSTEEGTSTEPSEGSAPGTSTEPSE GSAPGTSESATPESGPGSEPATSGSETPGSEPATSGSETPGSPAGSPTSTEEGTSESA TPESGPGTSTEPSEGSAPGTSTEPSEGSAPGSPAGSPTSTEEGTSTEPSEGSAPGTST EPSEGSAPGTSESATPESGPGTSTEPSEGSAPGTSESATPESGPGSEPATSGSETPGT STEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGS APGTSTEPSEGSAPGTSTEPSEGSAPGTSTEPSEGSAPGSPAGSPT STEEGTSTEPSEGSAPGTSESATPESGPGSEPATSGSETPGTSESATPESGPGSEPAT | 614 |

TABLE 3b-continued

| | Exemplary Existing ELNNs for Engineering into Barcoded ELNN(s) | |
|---|---|---|
| ELNN Name | Amino Acid Sequence | SEQ ID NO |
| | SGSETPGTSESATPESGPGTSTEPSEGSAPGTSESATPESGPGSPAGSPTSTEEGSPA GSPTSTEEGSPAGSPTSTEEGTSESATPESGPGTSTEPSEGSAP | |
| AE864 | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAP | 615 |
| AE865 | GGSPAGSPTSTEEGTSESATPESGPGTSTEPSEGSAPGSPAGSPTSTEEGTSTEPSEG SAPGTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGTSTEP SEGSAPGTSTEPSEGSAPGTSESATPESGPGTSTEPSEGSAPGTSESATPESGPGSEP ATSGSETPGTSTEPSEGSAPGTSTEPSEGSAPGTSESATPESGPGTSESATPESGPGS PAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGS APGSPAGSPTSTEEGTSTEPSEGSAPGTSESATPESGPGSEPATSGSETPGTSESATP ESGPGSEPATSGSETPGTSESATPESGPGTSTEPSEGSAPGTSESATPESGPGSPAGS PTSTEEGSPAGSPTSTEEGSPAGSPTSTEEGTSESATPESGPGTSTEPSEGSAPGTSES ATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPG SPAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAP | 616 |
| AE866 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAPG | 617 |
| AE1152 | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAPGTSESATP ESGPGSEPATSGSETPGTSESATPESGPGSEPATSGSETPGTSESATPESGPGTSTEPS EGSAPGSPAGSPTSTEEGTSESATPESGPGSEPATSGSETPGTSESATPESGPGSPAG SPTSTEEGSPAGSPTSTEEGTSTEPSEGSAPGTSESATPESGPGTSESATPESGPGTSE SATPESGPGSEPATSGSETPGSEPATSGSETPGSPAGSPTSTEEGTSTEPSEGSAPGT STEPSEGSAPGSEPATSGSETPGTSESATPESGPGTSTEPSEGSAP | 618 |
| AE144A | STEPSEGSAPGSPAGSPTSTEEGTSTEPSEGSAPGTSESATPESGPGSEPATSGSETP GTSESATPESGPGSEPATSGSETPGTSESATPESGPGTSTEPSEGSAPGTSESATPES GPGSPAGSPTSTEEGSPAGSPTSTEEGS | 619 |

TABLE 3b-continued

Exemplary Existing ELNNs for Engineering into Barcoded ELNN(s)

| ELNN Name | Amino Acid Sequence | SEQ ID NO |
|---|---|---|
| AE144B | SEPATSGSETPGTSESATPESGPGSEPATSGSETPGTSESATPESGPGTSTEPSEGSAP<br>GSPAGSPTSTEEGTSESATPESGPGSEPATSGSETPGTSESATPESGPGSPAGSPTST<br>EEGSPAGSPTSTEEGTSTEPSEGSAPG | 620 |
| AE180A | TSTEEGTSESATPESGPGSEPATSGSETPGTSESATPESGPGSPAGSPTSTEEGSPAG<br>SPTSTEEGTSTEPSEGSAPGTSESATPESGPGTSESATPESGPGTSESATPESGPGSEP<br>ATSGSETPGSEPATSGSETPGSPAGSPTSTEEGTSTEPSEGSAPGTSTEPSEGSAPGS<br>EPATS | 621 |
| AE216A | PESGPGTSTEPSEGSAPGSPAGSPTSTEEGTSESATPESGPGSEPATSGSETPGTSES<br>ATPESGPGSPAGSPTSTEEGSPAGSPTSTEEGTSTEPSEGSAPGTSESATPESGPGTS<br>ESATPESGPGTSESATPESGPGSEPATSGSETPGSEPATSGSETPGSPAGSPTSTEEG<br>TSTEPSEGSAPGTSTEPSEGSAPGSEPATSGSETPGTSESAT | 622 |
| AE252A | ESGPGSEPATSGSETPGTSESATPESGPGTSTEPSEGSAPGSPAGSPTSTEEGTSESA<br>TPESGPGSEPATSGSETPGTSESATPESGPGSPAGSPTSTEEGSPAGSPTSTEEGTST<br>EPSEGSAPGTSESATPESGPGTSESATPESGPGTSESATPESGPGSEPATSGSETPGS<br>EPATSGSETPGSPAGSPTSTEEGTSTEPSEGSAPGTSTEPSEGSAPGSEPATSGSETP<br>GTSESATPESGPGTSTEPSE | 623 |
| AE288A | TPESGPGTSTEPSEGSAPGTSESATPESGPGSEPATSGSETPGTSESATPESGPGSEP<br>ATSGSETPGTSESATPESGPGTSTEPSEGSAPGSPAGSPTSTEEGTSESATPESGPGS<br>EPATSGSETPGTSESATPESGPGSPAGSPTSTEEGSPAGSPTSTEEGTSTEPSEGSAP<br>GTSESATPESGPGTSESATPESGPGTSESATPESGPGSEPATSGSETPGSEPATSGSE<br>TPGSPAGSPTSTEEGTSTEPSEGSAPGTSTEPSEGSAPGSEPATSGSETPGTSESA | 624 |
| AE324A | PESGPGSPAGSPTSTEEGSPAGSPTSTEEGSPAGSPTSTEEGTSESATPESGPGTSTEP<br>SEGSAPGTSESATPESGPGSEPATSGSETPGTSESATPESGPGSEPATSGSETPGTSE<br>SATPESGPGTSTEPSEGSAPGSPAGSPTSTEEGTSESATPESGPGSEPATSGSETPGT<br>SESATPESGPGSPAGSPTSTEEGSPAGSPTSTEEGTSTEPSEGSAPGTSESATPESGP<br>GTSESATPESGPGTSESATPESGPGSEPATSGSETPGSEPATSGSETPGSPAGSPTST<br>EEGTSTEPSEGSAPGTSTEPSEGSAPGSEPATS | 625 |
| AE360A | PESGPGTSTEPSEGSAPGTSESATPESGPGSPAGSPTSTEEGSPAGSPTSTEEGSPAG<br>SPTSTEEGTSESATPESGPGTSTEPSEGSAPGTSESATPESGPGSEPATSGSETPGTSE<br>SATPESGPGSEPATSGSETPGTSESATPESGPGTSTEPSEGSAPGSPAGSPTSTEEGT<br>SESATPESGPGSEPATSGSETPGTSESATPESGPGSPAGSPTSTEEGSPAGSPTSTEE<br>GTSTEPSEGSAPGTSESATPESGPGTSESATPESGPGTSESATPESGPGSEPATSGSE<br>TPGSEPATSGSETPGSPAGSPTSTEEGTSTEPSEGSAPGTSTEPSEGSAPGSEPATSG<br>SETPGTSESAT | 626 |
| AE396A | PESGPGSEPATSGSETPGTSESATPESGPGTSTEPSEGSAPGTSESATPESGPGSPAG<br>SPTSTEEGSPAGSPTSTEEGSPAGSPTSTEEGTSESATPESGPGTSTEPSEGSAPGTSE<br>SATPESGPGSEPATSGSETPGTSESATPESGPGSEPATSGSETPGTSESATPESGPGT<br>STEPSEGSAPGSPAGSPTSTEEGTSESATPESGPGSEPATSGSETPGTSESATPESGP<br>GSPAGSPTSTEEGSPAGSPTSTEEGTSTEPSEGSAPGTSESATPESGPGTSESATPES<br>GPGTSESATPESGPGSEPATSGSETPGSEPATSGSETPGSPAGSPTSTEEGTSTEPSE<br>GSAPGTSTEPS | 627 |
| AE432A | EGSAPGSPAGSPTSTEEGTSTEPSEGSAPGTSESATPESGPGSEPATSGSETPGTSES<br>ATPESGPGSEPATSGSETPGTSESATPESGPGTSTEPSEGSAPGTSESATPESGPGSP<br>AGSPTSTEEGSPAGSPTSTEEGSPAGSPTSTEEGTSESATPESGPGTSTEPSEGSAPG<br>TSESATPESGPGSEPATSGSETPGTSESATPESGPGSEPATSGSETPGTSESATPESGP<br>GTSTEPSEGSAPGSPAGSPTSTEEGTSESATPESGPGSEPATSGSETPGTSESATPES<br>GPGSPAGSPTSTEEGSPAGSPTSTEEGTSTEPSEGSAPGTSESATPESGPGTSESATP<br>ESGPGTSESATPESGPGSEPATSGSETPGSEPATSGSETPGSPAGSPTSTEEGTSTEPS<br>EGSAPGTSTEPSEGSAPGSEPATS | 628 |
| AE468A | EGSAPGTSTEPSEGSAPGTSTEPSEGSAPGSPAGSPTSTEEGTSTEPSEGSAPGTSES<br>ATPESGPGSEPATSGSETPGTSESATPESGPGSEPATSGSETPGTSESATPESGPGTS<br>TEPSEGSAPGTSESATPESGPGSPAGSPTSTEEGSPAGSPTSTEEGSPAGSPTSTEEG<br>TSESATPESGPGTSTEPSEGSAPGTSESATPESGPGSEPATSGSETPGTSESATPESGP<br>GSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSE<br>GSAPGTSESATPESGPGTSESATPESGPGTSESATPESGPGSEPATSGSETPGSEPAT<br>SGSETPGSPAGSPTSTEEGTSTEPSEGSAPGTSTEPSEGSAPGSEPATSGSETPGTSES<br>AT | 629 |
| AE504A | EGSAPGTSTEPSEGSAPGTSTEPSEGSAPGTSTEPSEGSAPGTSTEPSEGSAPGSPAG<br>SPTSTEEGTSTEPSEGSAPGTSESATPESGPGSEPATSGSETPGTSESATPESGPGSEP<br>ATSGSETPGTSESATPESGPGTSTEPSEGSAPGTSESATPESGPGSPAGSPTSTEEGS<br>PAGSPTSTEEGSPAGSPTSTEEGTSESATPESGPGTSTEPSEGSAPGTSESATPESGP<br>GSEPATSGSETPGTSESATPESGPGSEPATSGSETPGTSESATPESGPGTSTEPSEGS<br>APGSPAGSPTSTEEGTSESATPESGPGSEPATSGSETPGTSESATPESGPGSPAGSPT | 630 |

TABLE 3b-continued

| ELNN Name | Amino Acid Sequence | SEQ ID NO |
|---|---|---|
| | STEEGSPAGSPTSTEEGTSTEPSEGSAPGTSESATPESGPGTSESA<br>TPESGPGSEPATSGSETPGSEPATSGSETPGSPAGSPTSTEEGTSTEPSEGSAPGTST<br>EPSEGSAPGSEPATSGSETPGTSESATPESGPGTSTEPS | |
| AE540A | TPESGPGSPAGSPTSTEEGTSESATPESGPGSEPATSGSETPGTSESATPESGPGTST<br>EPSEGSAPGTSTEPSEGSAPGTSTEPSEGSAPGTSTEPSEGSAPGT<br>STEPSEGSAPGSPAGSPTSTEEGTSTEPSEGSAPGTSESATPESGPGSEPATSGSETP<br>GTSESATPESGPGSEPATSGSETPGTSESATPESGPGTSTEPSEGSAPGTSESATPES<br>GPGSPAGSPTSTEEGSPAGSPTSTEEGSPAGSPTSTEEGTSESATPESGPGTSTEPSE<br>GSAPGTSESATPESGPGSEPATSGSETPGTSESATPESGPGSEPATSGSETPGTSESA<br>TPESGPGTSTEPSEGSAPGSPAGSPTSTEEGTSESATPESGPGSEPATSGSETPGTSES<br>ATPESGPGSPAGSPTSTEEGSPAGSPTSTEEGTSTEPSEGSAPGTSESATPESGPGTS<br>ESATPESGPGTSESATPESGPGSEPATSGSETPGSEPATSGSETPGSPAGSPTSTEEG<br>TSTEPSEGSAPGTSTEP | 631 |
| AE576A | TPESGPGTSESATPESGPGSPAGSPTSTEEGTSESATPESGPGSEPATSGSETPGTSES<br>ATPESGPGTSTEPSEGSAPGTSTEPSEGSAPGTSTEPSEGSAPGTSTEPSEGSAPGTS<br>TEPSEGSAPGTSTEPSEGSAPGSPAGSPTSTEEGTSTEPSEGSAPGTSESATPESGPG<br>SEPATSGSETPGTSESATPESGPGSEPATSGSETPGTSESATPESGPGTSTEPSEGSAP<br>GTSESATPESGPGSPAGSPTSTEEGSPAGSPTSTEEGSPAGSPTSTEEGTSESATPES<br>GPGTSTEPSEGSAPGTSESATPESGPGSEPATSGSETPGTSESATPESGPGSEPATSG<br>SETPGTSESATPESGPGTSTEPSEGSAPGSPAGSPTSTEEGTSESATPESGPGSEPATS<br>GSETPGTSESATPESGPGSPAGSPTSTEEGSPAGSPTSTEEGTSTEPSEGSAPGTSES<br>ATPESGPGTSESATPESGPGTSESATPESGPGSEPATSGSETPGSEPATSGSETPGSP<br>AGSPTSTEEGTSTEPSEGSAPGTSTEPSEGSAPGSEPATSGSETPGTSESA | 632 |
| AE612A | GSETPGTSTEPSEGSAPGTSTEPSEGSAPGTSESATPESGPGTSESATPESGPGSPAG<br>SPTSTEEGTSESATPESGPGSEPATSGSETPGTSESATPESGPGTSTEPSEGSAPGTST<br>EPSEGSAPGTSTEPSEGSAPGTSTEPSEGSAPGTSTEPSEGSAPGTSTEPSEGSAPGS<br>PAGSPTSTEEGTSTEPSEGSAPGTSESATPESGPGSEPATSGSETPGTSESATPESGP<br>GSEPATSGSETPGTSESATPESGPGTSTEPSEGSAPGTSESATPESGPGSPAGSPTST<br>EEGSPAGSPTSTEEGSPAGSPTSTEEGTSESATPESGPGTSTEPSEGSAPGTSESATP<br>ESGPGSEPATSGSETPGTSESATPESGPGSEPATSGSETPGTSESATPESGPGTSTEPS<br>EGSAPGSPAGSPTSTEEGTSESATPESGPGSEPATSGSETPGTSESATPESGPGSPAG<br>SPTSTEEGSPAGSPTSTEEGTSTEPSEGSAPGTSESATPESGPGTSESATPESGPGTSE<br>SATPESGPGSEPATSGSETPGSEPATSGSETPGSPAGSPTSTEEGTSTEPSEGSAPGT<br>STEPSEGSAPGSEPATSGSETPGTSESAT | 633 |
| AE648A | PESGPGTSTEPSEGSAPGTSESATPESGPGSEPATSGSETPGTSTEPSEGSAPGTSTEP<br>SEGSAPGTSESATPESGPGTSESATPESGPGSPAGSPTSTEEGTSESATPESGPGSEP<br>ATSGSETPGTSESATPESGPGTSTEPSEGSAPGTSTEPSEGSAPGT<br>STEPSEGSAPGTSTEPSEGSAPGTSTEPSEGSAPGSPAGSPTSTEEGTSTEPSEGSAP<br>GTSESATPESGPGSEPATSGSETPGTSESATPESGPGSEPATSGSETPGTSESATPES<br>GPGTSTEPSEGSAPGTSESATPESGPGSPAGSPTSTEEGSPAGSPTSTEEGSPAGSPT<br>STEEGTSESATPESGPGTSTEPSEGSAPGTSESATPESGPGSEPATSGSETPGTSESA<br>TPESGPGSEPATSGSETPGTSESATPESGPGTSTEPSEGSAPGSPAGSPTSTEEGTSES<br>ATPESGPGSEPATSGSETPGTSESATPESGPGSPAGSPTSTEEGSPAGSPTSTEEGTS<br>TEPSEGSAPGTSESATPESGPGTSESATPESGPGTSESATPESGPGSEPATSGSETPG<br>SEPATSGSETPGSPAGSPTSTEEGTSTEPSEGSAPGTSTEPSEGSAPGSEPATSGSETP<br>GTSESAT | 634 |
| AE684A | EGSAPGSPAGSPTSTEEGTSTEPSEGSAPGTSTEPSEGSAPGTSESATPESGPGTSTE<br>PSEGSAPGTSESATPESGPGSEPATSGSETPGTSTEPSEGSAPGTSTEPSEGSAPGTS<br>ESATPESGPGTSESATPESGPGSPAGSPTSTEEGTSESATPESGPGSEPATSGSETPG<br>TSESATPESGPGTSTEPSEGSAPGTSTEPSEGSAPGTSTEPSEGSAPGTSTEPSEGSAP<br>GTSTEPSEGSAPGTSTEPSEGSAPGSPAGSPTSTEEGTSTEPSEGSAPGTSESATPES<br>GPGSEPATSGSETPGTSESATPESGPGSEPATSGSETPGTSESATPESGPGTSTEPSE<br>GSAPGTSESATPESGPGSPAGSPTSTEEGSPAGSPTSTEEGTSESA<br>TPESGPGTSTEPSEGSAPGTSESATPESGPGSEPATSGSETPGTSESATPESGPGSEP<br>ATSGSETPGTSESATPESGPGTSTEPSEGSAPGSPAGSPTSTEEGTSESATPESGPGS<br>EPATSGSETPGTSESATPESGPGSPAGSPTSTEEGSPAGSPTSTEEGTSTEPSEGSAP<br>GTSESATPESGPGTSESATPESGPGTSESATPESGPGSEPATSGSETPGSEPATSGSE<br>TPGSPAGSPTSTEEGTSTEPSEGSAPGTSTEPSEGSAPGSEPATS | 635 |
| AE720A | TSGSETPGSEPATSGSETPGSPAGSPTSTEEGTSESATPESGPGTSTEPSEGSAPGTS<br>TEPSEGSAPGSPAGSPTSTEEGTSTEPSEGSAPGTSTEPSEGSAPGTSESATPESGPG<br>TSTEPSEGSAPGTSESATPESGPGSEPATSGSETPGTSTEPSEGSAPGTSTEPSEGSAP<br>GTSESATPESGPGTSESATPESGPGSPAGSPTSTEEGTSESATPESGPGSEPATSGSE<br>TPGTSESATPESGPGTSTEPSEGSAPGTSTEPSEGSAPGTSTEPSEGSAPGTSTEPSE<br>GSAPGTSTEPSEGSAPGTSTEPSEGSAPGSPAGSPTSTEEGTSTEPSEGSAPGTSESA<br>TPESGPGSEPATSGSETPGTSESATPESGPGSEPATSGSETPGTSESATPESGPGTST<br>EPSEGSAPGTSESATPESGPGSPAGSPTSTEEGSPAGSPTSTEEGSPAGSPTSTEEGT<br>SESATPESGPGTSTEPSEGSAPGTSESATPESGPGSEPATSGSETPGTSESATPESGP<br>GSEPATSGSETPGTSESATPESGPGTSTEPSEGSAPGSPAGSPTSTEEGTSESATPES<br>GPGSEPATSGSETPGTSESATPESGPGSPAGSPTSTEEGSPAGSPTSTEEGTSTEPSE | 636 |

TABLE 3b-continued

<u>Exemplary Existing ELNNs for Engineering into Barcoded ELNN(s)</u>

| ELNN Name | Amino Acid Sequence | SEQ ID NO |
|---|---|---|
| | GSAPGTSESATPESGPGTSESATPESGPGTSESATPESGPGSEPATSGSETPGSEPAT SGSETPGSPAGSPTSTEEGTSTE | |
| AE756A | TSGSETPGSEPATSGSETPGSPAGSPTSTEEGTSESATPESGPGTSTEPSEGSAPGTS TEPSEGSAPGSPAGSPTSTEEGTSTEPSEGSAPGTSTEPSEGSAPGTSESATPESGPG TSTEPSEGSAPGTSESATPESGPGSEPATSGSETPGTSTEPSEGSAPGTSTEPSEGSAP GTSESATPESGPGTSESATPESGPGSPAGSPTSTEEGTSESATPESGPGSEPATSGSE TPGTSESATPESGPGTSTEPSEGSAPGTSTEPSEGSAPGTSTEPSE GSAPGTSTEPSEGSAPGTSTEPSEGSAPGSPAGSPTSTEEGTSTEPSEGSAPGTSESA TPESGPGSEPATSGSETPGTSESATPESGPGSEPATSGSETPGTSESATPESGPGTST EPSEGSAPGTSESATPESGPGSPAGSPTSTEEGSPAGSPTSTEEGSPAGSPTSTEEGT SESATPESGPGTSTEPSEGSAPGTSESATPESGPGSEPATSGSETPGTSESATPESGP GSEPATSGSETPGTSESATPESGPGTSTEPSEGSAPGSPAGSPTSTEEGTSESATPES GPGSEPATSGSETPGTSESATPESGPGSPAGSPTSTEEGSPAGSPTSTEEGTSTEPSE GSAPGTSESATPESGPGTSESATPESGPGTSESATPESGPGSEPATSGSETPGSEPAT SGSETPGSPAGSPTSTEEGTSTEPSEGSAPGTSTEPSEGSAPGSEPATSGSETPGTSES | 637 |
| AE792A | EGSAPGTSESATPESGPGSEPATSGSETPGSEPATSGSETPGSPAGSPTSTEEGTSES ATPESGPGTSTEPSEGSAPGTSTEPSEGSAPGSPAGSPTSTEEGTSTEPSEGSAPGTS TEPSEGSAPGTSESATPESGPGTSTEPSEGSAPGTSESATPESGPGSEPATSGSETPG TSTEPSEGSAPGTSTEPSEGSAPGTSESATPESGPGTSESATPESGPGSPAGSPTSTEE GTSESATPESGPGSEPATSGSETPGTSESATPESGPGTSTEPSEGSAPGTSTEPSEGS APGTSTEPSEGSAPGTSTEPSEGSAPGTSTEPSEGSAPGTSTEPSEGSAPGSPAGSPT STEEGTSTEPSEGSAPGTSESATPESGPGSEPATSGSETPGTSESATPESGPGSEPAT SGSETPGTSESATPESGPGTSTEPSEGSAPGTSESATPESGPGSPAGSPTSTEEGSPA GSPTSTEEGSPAGSPTSTEEGTSESATPESGPGTSTEPSEGSAPGTSESATPESGPGS EPATSGSETPGTSESATPESGPGSEPATSGSETPGTSESATPESGPGTSTEPSEGSAP GSPAGSPTSTEEGTSESATPESGPGSEPATSGSETPGTSESATPESGPGSPAGSPTST EEGSPAGSPTSTEEGTSTEPSEGSAPGTSESATPESGPGTSESATPESGPGTSESATP ESGPGSEPATSGSETPGSEPATSGSETPGSPAGSPTSTEEGTSTEPSEGSAPGTSTEPS EGSAPGSEPATSGSETPGTSESATPESGPGTSTEPS | 638 |
| AE828A | PESGPGTSTEPSEGSAPGSPAGSPTSTEEGTSTEPSEGSAPGTSTEPSEGSAPGTSES ATPESGPGSEPATSGSETPGSEPATSGSETPGSPAGSPTSTEEGTSESATPESGPGTS TEPSEGSAPGTSTEPSEGSAPGSPAGSPTSTEEGTSTEPSEGSAPGTSTEPSEGSAPG TSESATPESGPGTSTEPSEGSAPGTSESATPESGPGSEPATSGSETPGTSTEPSEGSAP GTSTEPSEGSAPGTSESATPESGPGTSESATPESGPGSPAGSPTSTEEGTSESATPES GPGSEPATSGSETPGTSESATPESGPGTSTEPSEGSAPGTSTEPSEGSAPGTSTEPSE GSAPGTSTEPSEGSAPGTSTEPSEGSAPGSPAGSPTSTEEGTSTEP SEGSAPGTSESATPESGPGSEPATSGSETPGTSESATPESGPGSEPATSGSETPGTSE SATPESGPGTSTEPSEGSAPGTSESATPESGPGSPAGSPTSTEEGSPAGSPTSTEEGS PAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSPT STEEGTSTEPSEGSAPGTSESATPESGPGTSESATPESGPGTSESATPESGPGSEPAT SGSETPGSEPATSGSETPGSPAGSPTSTEEGTSTEPSEGSAPGTSTEPSEGSAPGSEP ATSGSETPGTSESAT | 639 |
| AE869 | GSPGSPAGSPTSTEEGTSESATPESGPGTSTEPSEGSAPGSPAGSPTSTEEGTSTEPSE GSAPGTSTEPSEGSAPGTSESATPESGPGSEPATSGSETPGSEPATSGSETPGSPAGS PTSTEEGTSESATPESGPGTSTEPSEGSAPGTSTEPSEGSAPGSPAGSPTSTEEGTSTE PSEGSAPGTSTEPSEGSAPGTSESATPESGPGTSTEPSEGSAPGTSESATPESGPG SEPATSGSETPGTSTEPSEGSAPGTSTEPSEGSAPGTSESATPESGPGTSESATPESGPG SPAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGSAPGTSTEPSEGS APGSPAGSPTSTEEGTSTEPSEGSAPGTSESATPESGPGSEPATSGSETPGTSESATP ESGPGSEPATSGSETPGTSESATPESGPGTSTEPSEGSAPGTSESATPESGPGSPAGS PTSTEEGSPAGSPTSTEEGSPAGSPTSTEEGTSESATPESGPGTSTEPSEGSAPGTSES ATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPG SPAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAPGR | 640 |
| AE144_R1 | SAGSPGSPAGSPTSTEEGTSESATPESGPGTSTEPSEGSAPGSPAGSPTSTEEGTSTE PSEGSAPGTSTEPSEGSAPGTSESATPESGPGSEPATSGSETPGSEPATSGSETPGSP AGSPTSTEEGTSESATPESGPGTESASR | 641 |
| AE288_R1 | SAGSPTGPGSEPATSGSETPGTSESATPESGPGSEPATSGSETPGTSESATPESGPGT STEPSEGSAPGSPAGSPTSTEEGTSESATPESGPGSEPATSGSETPGTSESATPESGP GSPAGSPTSTEEGSPAGSPTSTEEGTSTEPSEGSAPGTSESATPESGPGTSESATPES GPGTSESATPESGPGSEPATSGSETPGSEPATSGSETPGSPAGSPTSTEEGTSTEPSE GSAPGTSTEPSEGSAPGSEPATSGSETPGTSESATPESGPGTSTEPSEGSAPSASR | 642 |

TABLE 3b-continued

| ELNN Name | Amino Acid Sequence | SEQ ID NO |
|---|---|---|
| AE432_R1 | SAGSPGSPAGSPTSTEEGTSESATPESGPGTSTEPSEGSAPGSPAGSPTSTEEGTSTE<br>PSEGSAPGTSTEPSEGSAPGTSESATPESGPGSEPATSGSETPGSEPATSGSETPGSP<br>AGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPES<br>GPGSPAGSPTSTEEGTSESATPESGPGSEPATSGSETPGTSESATPESGPGTSTEPSE<br>GSAPGTSTEPSEGSAPGTSTEPSEGSAPGTSTEPSEGSAPGTSTEP<br>SEGSAPGSPAGSPTSTEEGTESASR | 643 |
| AE576_R1 | SAGSPTEEGTSESATPESGPGSEPATSGSETPGTSESATPESGPGTSTEPSEGSAPGT<br>STEPSEGSAPGTSTEPSEGSAPGTSTEPSEGSAPGTSTEPSEGSAPGTSTEPSEGSAP<br>GSPAGSPTSTEEGTSTEPSEGSAPGTSESATPESGPGSEPATSGSETPGTSESATPES<br>GPGSEPATSGSETPGTSESATPESGPGTSTEPSEGSAPGTSESATPESGPGSPAGSPT<br>STEEGSPAGSPTSTEEGSPAGSPTSTEEGTSESATPESGPGTSTEPSEGSAPGTSESA<br>TPESGPGSEPATSGSETPGTSESATPESGPGSEPATSGSETPGTSESATPESGPGTST<br>EPSEGSAPGSPAGSPTSTEEGTSESATPESGPGSEPATSGSETPGTSESATPESGPGS<br>PAGSPTSTEEGSPAGSPTSTEEGTSTEPSEGSAPGTSESATPESGPGTSESATPESGP<br>GTSESATPESGPGSEPATSGSETPGSEPATSGSETPGSPAGSPTSTEEGTSTEPSEGS<br>APGTSTEPSEGSAPGSEPATSGSETPGTSESATPESGPGTSTEPSEGSAPSASR | 644 |
| AE864_R1 | SAGSPGSPAGSPTSTEEGTSESATPESGPGTSTEPSEGSAPGSPAGSPTSTEEGTSTE<br>PSEGSAPGTSTEPSEGSAPGTSESATPESGPGSEPATSGSETPGSEPATSGSETPGSP<br>AGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPES<br>GPGSPAGSPTSTEEGTSESATPESGPGSEPATSGSETPGTSESATPESGPGTSTEPSE<br>GSAPGTSTEPSEGSAPGTSTEPSEGSAPGTSTEPSEGSAPGTSTEP<br>SEGSAPGSPAGSPTSTEEGTSTEPSEGSAPGTSESATPESGPGSEPATSGSETPGTSE<br>SATPESGPGSEPATSGSETPGTSESATPESGPGTSTEPSEGSAPGTSESATPESGPGS<br>PAGSPTSTEEGSPAGSPTSTEEGSPAGSPTSTEEGTSESATPESGPGTSTEPSEGSAP<br>GTSESATPESGPGSEPATSGSETPGTSESATPESGPGSEPATSGSETPGTSESATPES<br>GPGTSTEPSEGSAPGSPAGSPTSTEEGTSESATPESGPGSEPATSGSETPGTSESATP<br>ESGPGSPAGSPTSTEEGSPAGSPTSTEEGTSTEPSEGSAPGTSESATPESGPGTSESA<br>TPESGPGTSESATPESGPGSEPATSGSETPGSEPATSGSETPGSPAGSPTSTEEGTST<br>EPSEGSAPGTSTEPSEGSAPGSEPATSGSETPGTSESATPESGPGTESASR | 645 |
| AE712 | PGSPAGSPTSTEEGTSESATPESGPGTSTEPSEGSAPGSPAGSPTSTEEGTSTEPSEGS<br>APGTSTEPSEGSAPGTSESATPESGPGSEPATSGSETPGSEPATSGSETPGSPAGSPT<br>STEEGTSESATPESGPGTSTEPSEGSAPGTSTEPSEGSAPGSPAGSPTSTEEGTSTEPS<br>EGSAPGTSTEPSEGSAPGTSESATPESGPGTSTEPSEGSAPGTSESATPESGPGSEPA<br>TSGSETPGTSTEPSEGSAPGTSTEPSEGSAPGTSESATPESGPGTSESATPESGPGSP<br>AGSPTSTEEGTSESATPESGPGSEPATSGSETPGTSESATPESGPGTSTEPSEGSAPG<br>TSTEPSEGSAPGTSTEPSEGSAPGTSTEPSEGSAPGTSTEPSEGSAP<br>GSPAGSPTSTEEGTSTEPSEGSAPGTSESATPESGPGSEPATSGSETPGTSESATPES<br>GPGSEPATSGSETPGTSESATPESGPGTSTEPSEGSAPGTSESATPESGPGSPAGSPT<br>STEEGSPAGSPTSTEEGSPAGSPTSTEEGTSESATPESGPGTSTEPSEGSAPGTSESA<br>TPESGPGSEPATSGSETPGTSESATPESGPGSEPATSGSETPGTSESATPESGPGTST<br>EPSEGSAPGSPAGSPTSTEEGTSESATPESGPGSEPATSGSETPGTSESATPESGPGS<br>PAGSPTSTEAHHH | 646 |
| AE864_R2 | GSPGAGSPAGSPTSTEEGTSESATPESGPGTSTEPSEGSAPGSPAGSPTSTEEGTSTE<br>PSEGSAPGTSTEPSEGSAPGTSESATPESGPGSEPATSGSETPGSEPATSGSETPGSP<br>AGSPTSTEEGTSESATPESGPGTSTEPSEGSAPGTSTEPSEGSAPGSPAGSPTSTEEG<br>TSTEPSEGSAPGTSTEPSEGSAPGTSESATPESGPGTSTEPSEGSAPGTSESATPESGP<br>GSEPATSGSETPGTSTEPSEGSAPGTSTEPSEGSAPGTSESATPESGPGTSESATPES<br>GPGSPAGSPTSTEEGTSESATPESGPGSEPATSGSETPGTSESATPESGPGTSTEPSE<br>GSAPGTSTEPSEGSAPGTSTEPSEGSAPGTSTEPSEGSAPGTSTEP<br>SEGSAPGSPAGSPTSTEEGTSTEPSEGSAPGTSESATPESGPGSEPATSGSETPGTSE<br>SATPESGPGSEPATSGSETPGTSESATPESGPGTSTEPSEGSAPGTSESATPESGPGS<br>PAGSPTSTEEGSPAGSPTSTEEGSPAGSPTSTEEGTSESATPESGPGTSTEPSEGSAP<br>GTSESATPESGPGSEPATSGSETPGTSESATPESGPGSEPATSGSETPGTSESATPES<br>GPGTSTEPSEGSAPGSPAGSPTSTEEGTSESATPESGPGSEPATSGSETPGTSESATP<br>ESGPGSPAGSPTSTEEGSPAGSPTSTEEGTSTEPSEGSAPGTSESATPESGPGTSESA<br>TPESGPGTSESATPESGPGSEPATSGSETPGSEPATSGSETPGSPAGSPTSTEEGTST<br>EPSEGSAPGTSTEPSEGSAPGSEPATSGSETPGTSESATPESGPGTESASR | 647 |
| AE288_3 | SPAGSPTSTEEGTSESATPESGPGTSTEPSEGSAPGTSESATPESGPGSEPATSGSETP<br>GTSESATPESGPGSEPATSGSETPGTSESATPESGPGTSTEPSEGSAPGSPAGSPTST<br>EEGTSESATPESGPGSEPATSGSETPGTSESATPESGPGSPAGSPTSTEEGSPAGSPT<br>STEEGTSTEPSEGSAPGTSESATPESGPGTSESATPESGPGTSESATPESGPGSEPAT<br>SGSETPGSEPATSGSETPGSPAGSPTSTEEGTSTEPSEGSAPGTSTEPSEGSAPG | 648 |
| AE284 | GTSESATPESGPGSEPATSGSETPGTSESATPESGPGSEPATSGSETPGTSESATPES<br>GPGTSTEPSEGSAPGSPAGSPTSTEEGTSESATPESGPGSEPATSGSETPGTSESATP | 649 |

TABLE 3b-continued

Exemplary Existing ELNNs for Engineering into Barcoded ELNN(s)

| ELNN Name | Amino Acid Sequence | SEQ ID NO |
|---|---|---|
| | ESGPGSPAGSPTSTEEGSPAGSPTSTEEGTSTEPSEGSAPGTSESATPESGPGTSESA TPESGPGTSESATPESGPGSEPATSGSETPGSEPATSGSETPGSPAGSPTSTEEGTST EPSEGSAPGTSTEPSEGSAPGSEPATSGSETPGTSESATPESGPGTSTEPSE | |
| AE292 | SPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSPT STEEGTSTEPSEGSAPGTSESATPESGPGTSESATPESGPGTSESATPESGPGSEPAT SGSETPGSEPATSGSETPGSPAGSPTSTEEGTSTEPSEGSAPGTSTEPSEGSAPGGSA P | 650 |
| AE864_2 | AGSPTSTEEGTSESATPESGPGTSTEPSEGSAPGSPAGSPTSTEEGTSTEPSEGSAPG TSTEPSEGSAPGTSESATPESGPGSEPATSGSETPGSEPATSGSETPGSPAGSPTSTEE GTSESATPESGPGTSTEPSEGSAPGTSTEPSEGSAPGSPAGSPTSTEEGTSTEPSEGS APGTSTEPSEGSAPGTSESATPESGPGTSTEPSEGSAPGTSESATPESGPGSEPATSG SETPGTSTEPSEGSAPGTSTEPSEGSAPGTSESATPESGPGSEPATSGSETPESGPGSPAGS PTSTEEGTSESATPESGPGSEPATSGSETPGTSESATPESGPGTSTEPSEGSAPGTSTE PSEGSAPGTSTEPSEGSAPGTSTEPSEGSAPGTSTEPSEGSAPGSP AGSPTSTEEGTSTEPSEGSAPGTSESATPESGPGSEPATSGSETPGTSESATPESGPG SEPATSGSETPGTSESATPESGPGTSTEPSEGSAPGTSESATPESGPGSPAGSPTSTEE GSPAGSPTSTEEGTSESATPESGPGTSTEPSEGSAPGTSESATPES GPGSEPATSGSETPGTSESATPESGPGSEPATSGSETPGTSESATPESGPGTSTEPSE GSAPGSPAGSPTSTEEGTSESATPESGPGSEPATSGSETPGTSESATPESGPGSPAGS PTSTEEGSPAGSPTSTEEGTSTEPSEGSAPGTSESATPESGPGTSES ATPESGPGSEPATSGSETPGSEPATSGSETPGSPAGSPTSTEEGTSTEPSEGSAPGTS TEPSEGSAPGSEPATSGSETPGTSESATPESGPGTSTEPSEGAAEPEA | 651 |
| AE867 | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGAAEPEA | 652 |
| AE867_2 | SPGSPAGSPTSTEEGTSESATPESGPGTSTEPSEGSAPGSPAGSPTSTEEGTSTEPSEG SAPGTSTEPSEGSAPGTSESATPESGPGSEPATSGSETPGSEPATSGSETPGSPAGSP TSTEEGTSESATPESGPGTSTEPSEGSAPGTSTEPSEGSAPGSPAGSPTSTEEGTSTEP SEGSAPGTSTEPSEGSAPGTSESATPESGPGTSTEPSEGSAPGTSESATPESGPGSEP ATSGSETPGTSTEPSEGSAPGTSTEPSEGSAPGTSESATPESGPGTSESATPESGPGS PAGSPTSTEEGTSESATPESGPGSEPATSGSETPGTSESATPESGPGTSTEPSEGSAP GTSTEPSEGSAPGTSTEPSEGSAPGTSTEPSEGSAPGTSTEPSEGS APGSPAGSPTSTEEGTSTEPSEGSAPGTSESATPESGPGSEPATSGSETPGTSESATP ESGPGSEPATSGSETPGTSESATPESGPGTSTEPSEGSAPGTSESATPESGPGSPAGS PTSTEEGSPAGSPTSTEEGTSESATPESGPGTSTEPSEGSAPGTSES ATPESGPGSEPATSGSETPGTSESATPESGPGSEPATSGSETPGTSESATPESGPGTS TEPSEGSAPGSPAGSPTSTEEGTSESATPESGPGSEPATSGSETPGTSESATPESGPG SPAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGSAPG | 653 |
| AE868 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGTSESA TPESGPGSEPATSGSETPGTSESATPESGPGSEPATSGSETPGTSESATPESGPGTST EPSEGSAPGSPAGSPTSTEEGTSESATPESGPGSEPATSGSETPGTSESATPESGPGS PAGSPTSTEEGSPAGSPTSTEEGTSTEPSEGSAPGTSESATPESGPGTSESATPESGP GTSESATPESGPGSEPATSGSETPGSEPATSGSETPGSPAGSPTSTEEGTSTEPSEGS APGTSTEPSEGSAPGSEPATSGSETPGTSESATPESGPGTSTEPSEGAAEPEA | 654 |

TABLE 3b-continued

Exemplary Existing ELNNs for Engineering into Barcoded ELNN(s)

| ELNN Name | Amino Acid Sequence | SEQ ID NO |
|---|---|---|
| AE144_7A | GSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAP | 655 |
| AE292 | SPAGSPTSTEEGTSESATPESGPGTSTEPSEGSAPGTSESATPESGPGSEPATSGSETP GTSESATPESGPGSEPATSGSETPGTSESATPESGPGTSTEPSEGSAPGSPAGSPTST EEGTSESATPESGPGSEPATSGSETPGTSESATPESGPGSPAGSPTSTEEGSPAGSPT STEEGTSTEPSEGSAPGTSESATPESGPGTSESATPESGPGTSESATPESGPGSEPAT SGSETPGSEPATSGSETPGSPAGSPTSTEEGTSTEPSEGSAPGTSTEPSEGSAPGGSA P | 656 |
| AE293 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPEGAAEPE A | 657 |
| AE300 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGAAEPEA | 658 |
| AE584 | PGSPAGSPTSTEEGTSESATPESGPGTSTEPSEGSAPGSPAGSPTSTEEGTSTEPSEGS APGTSTEPSEGSAPGTSESATPESGPGSEPATSGSETPGSEPATSGSETPGSPAGSPT STEEGTSESATPESGPGTSTEPSEGSAPGTSTEPSEGSAPGSPAGSPTSTEEGTSTEPS EGSAPGTSTEPSEGSAPGTSESATPESGPGTSTEPSEGSAPGTSESATPESGPGSEPA TSGSETPGTSTEPSEGSAPGTSTEPSEGSAPGTSESATPESGPGTSESATPESGPGSP AGSPTSTEEGTSESATPESGPGSEPATSGSETPGTSESATPESGPGTSTEPSEGSAPG TSTEPSEGSAPGTSTEPSEGSAPGTSTEPSEGSAPGTSTEPSEGSAPGTSTEPSEGSAP GSPAGSPTSTEEGTSTEPSEGSAPGTSESATPESGPGSEPATSGSETPGTSESATPES GPGSEPATSGSETPGTSESATPESGPGTSTEPSEGSAPGTSESATPESGPGSPAGSPT STEEGSPAGSPTSTEEGSPAGSPTSTEEGTSESATPESGPGTSTEPSEGSAPGAAEPE A | 659 |

In some embodiments, for constructing the sequence of a barcoded ELNN, amino-acid mutations are performed on ELNN of intermediate lengths to those of Table 3b, as well as ELNN of longer lengths than those of Table 3b, such as those in which one or more 12-mer motifs of Table 1 are added to the N- or C-terminus of a general-purpose ELNN of Table 3b.

Additional examples of existing ELNNs that can be used according to the present disclosure are disclosed in U.S. Patent Publication Nos. 2010/0239554 A1, 2010/0323956 A1, 2011/0046060 A1, 2011/0046061 A1, 2011/0077199 A1, or 2011/0172146 A1, or International Patent Publication Nos. WO 2010091122 A1, WO 2010144502 A2, WO 2010144508 A1, WO 2011028228 A1, WO 2011028229 A1, WO 2011028344 A2, WO 2014/011819 A2, or WO 2015/023891.

In some embodiments, a barcoded ELNN fused within a polypeptide chain adjacent to the N-terminus of the polypeptide chain ("N-terminal ELNN") can be attached to a His tag of HHHHHH (SEQ ID NO: 48) or HHHHHHHH (SEQ ID NO: 49) at the N-terminus to facilitate the purification of the fusion polypeptide. In some embodiments, a barcoded ELNN fused within a polypeptide chain at the C-terminus of the polypeptide chain ("C-terminal ELNN") can be comprise or be attached to the sequence EPEA at the C-terminus to facilitate the purification of the fusion polypeptide. In some embodiments, the fusion polypeptide comprises both an N-terminal barcoded ELNN and a C-terminal barcoded ELNN, wherein the N-terminal barcoded ELNN is attached to a His tag of HHHHHH (SEQ ID NO: 48) or HHHHHHHH (SEQ ID NO: 49) at the N-terminus; and wherein the C-terminal barcoded ELNN is attached to the sequence EPEA at the C-terminus, thereby facilitating purification of the fusion polypeptide, for example, to at least 85%, 90%, 91%, 92%, 93%, 94%, 95%, 96%, 97%, 98%, or at least 99% purity by chromatography methods known in the art, including but not limited to IMAC chromatography, C-tagXL affinity matrix, and other such methods.

A barcode fragment, as described herein, can be cleavably fused within the ELNN and releasable (i.e., configured to be released) from the ELNN upon digestion of the polypeptide by a protease. In some embodiments, the protease is a Glu-C protease. In some embodiments, the protease cleaves on the C-terminal side of glutamic acid residues that are not followed by proline. In some embodiments, a barcoded ELNN (an ELNN that contains barcode fragment(s) therewithin) is designed to achieve high efficiency, precision and accuracy of the protease digestion. For example, in some embodiments, adjacent Glu-Glu (EE) residues in an ELNN sequence can result in varying cleavage patterns upon Glu-C digestion. Accordingly, when Glu-C protease is used for barcode release, the barcoded ELNN or the barcode fragment(s) may not contain any Glu-Glu (EE) sequence. Additionally, a di-peptide Glu-Pro (EP) sequence, if present in the fusion polypeptide, may not be cleaved by Glu-C protease during the barcode release process.

Structural Configuration of Activatable Tces

In some embodiments, a fusion protein comprises a single BsAb in the form of a TCE and a single ELNN. In some embodiments, such a fusion protein can have at least the following permutations of configurations, each listed in an N- to C-terminus orientation: (TCE)-(ELNN); (ELNN)-(TCE); (TCE)-(Linker)-(ELNN); and (ELNN)-(Linker)-(TCE).

In some embodiments, the fusion protein comprises a C-terminal ELNN and, optionally, a linker (such as one described herein, e.g., in Table C) between the ELNN and the TCE. In some embodiments, such a fusion protein can be represented by Formula I (depicted N- to C-terminus):

$$(TCE)\text{-}(Linker)\text{-}(ELNN) \qquad (I),$$

wherein the TCE is as described herein; Linker is a linker sequence (such as one described herein, e.g., in Table C) comprising between 1 to about 50 amino acid residues that can optionally include a TCE release segment (e.g., as described herein); and the ELNN can be any ELNN described herein.

In some embodiments, the fusion protein comprises an N-terminal ELNN and, optionally, a linker (such as one described herein, e.g., in Table C) between the ELNN and the TCE. In some embodiments, such a fusion protein can be represented by Formula II (depicted N- to C-terminus):

$$(ELNN)\text{-}(Linker)\text{-}(TCE) \qquad (II),$$

wherein TCE is as described herein; Linker is a linker sequence (such as one described herein, e.g., in Table C) comprising between 1 to about 50 amino acid residues that can optionally include a TCE release segment (e.g., as described herein); and ELNN can be any ELNN described herein.

In some embodiments, the fusion protein comprises both an N-terminal ELNN and a C-terminal ELNN. In some embodiments, such a fusion protein can be represented by Formula III:

$$(ELNN)\text{-}(Linker)\text{-}(TCE)\text{-}(Linker)\text{-}(ELNN) \qquad (III)$$

wherein TCE is as described herein; each Linker is, individually, a linker sequence (such as one described herein, e.g., in Table C) having between 1 to about 50 amino acid residues that can optionally include a TCE release segment (e.g., as described herein); and each ELNN can be, individually, any ELNN described herein.

The present disclosure provides BsAbs (e.g., TCEs) comprise one or more sequences disclosed herein in any one of Tables 5a-5f.

Of particular interest are BsAbs (e.g., TCEs) for which an increase in a pharmacokinetic parameter, increased solubility, increased stability, masking of activity, or some other enhanced pharmaceutical property is sought, or those BsAbs (e.g., TCEs) for which increasing the terminal half-life would improve efficacy, and/or safety. Thus, the paTCE fusion protein compositions are prepared with various objectives in mind, including improving the therapeutic efficacy of the TCE by, for example, increasing the in vivo exposure or the length that the TCE remains within the therapeutic window when administered to a subject, compared to a TCE not linked to any ELNNs.

It will be appreciated that various amino acid substitutions (especially conservative amino acid substitutions) can be made in a bispecific sequence to create variants without departing from the spirit of the present disclosure with respect to the biological activity or pharmacologic properties of, e.g., a TCE. Examples of conservative substitutions for amino acids in polypeptide sequences are shown in Table 4. In addition, variants can also include, for instance, polypeptides wherein one or more amino acid residues are added or deleted at the N- or C-terminus of the full-length native amino acid sequence of a TCE that retains at least a portion of the biological activity of the native peptide.

In some embodiments, sequences that retain at least about 40%, or about 50%, or about 55%, or about 60%, or about 70%, or about 80%, or about 90%, or about 95% or more of the activity compared to the corresponding original TCE sequence would be considered suitable for inclusion in the subject paTCE. In some embodiments, a TCE found to retain a suitable level of activity can be linked to one or more ELNN polypeptides, having at least about 80% sequence identity (e.g., at least about 81%, at least about 82%, at least about 83%, at least about 84%, at least about 85%, at least about 86%, at least about 87%, at least about 88%, at least about 89%, at least about 90%, at least about 91%, at least about 92%, at least about 93%, at least about 94%, at least about 95%, at least about 96%, at least about 97%, at least about 98%, at least about 99%, or 100% sequence identity) to a sequence from Tables 3a-3b.

TABLE 4

| Exemplary conservative amino acid substitutions | |
| --- | --- |
| Original Residue | Exemplary Substitutions |
| Ala (A) | val; leu; ile |
| Arg (R) | lys; gin; asn |
| Asn (N) | gin; his; lys; arg |
| Asp (D) | Glu |
| Cys (C) | Ser |
| Gln (Q) | Asn |
| Glu (E) | Asp |
| Gly (G) | Pro |
| His (H) | asn: gin: lys: arg |
| Ile (I) | leu; val; met; ala; phe: norleucine |
| Leu (L) | norleucine: ile: val; met; ala: phe |
| Lys (K) | arg: gin: asn |
| Met (M) | leu; phe; ile |
| Phe (F) | leu: val: ile; ala |
| Pro (P) | gly |
| Ser (S) | thr |
| Thr (T) | ser |
| Trp (W) | tyr |
| Tyr(Y) | trp: phe: thr: ser |
| Val (V) | ile; leu; met; phe; ala; norleucine |

The present disclosure provides ELNNylated TCEs (such as paTCEs) that target EGFR, wherein TCE is a bispecific antibody (e.g., a bispecific TCE) that specifically binds to EGFR with one portion of the bispecific TCE and CD3 with the other portion of the bispecific TCE.

In some embodiments, the ELNNylated TCE comprises (1) a first portion comprising a first binding domain and a second binding domain, and (2) a second portion comprising a release segment, and (3) a third portion comprising an unstructured polypeptide mask (also sometimes referred to herein as a masking moiety).

In some embodiments, the ELNNylated TCE comprises the configuration of Formula Ia (depicted N-terminus to C-terminus):

$$(\text{first portion})\text{-}(\text{second portion})\text{-}(\text{third portion}) \qquad (Ia)$$

wherein first portion is a bispecific antibody domain comprising two antigen binding domains as noted above wherein the first binding domain has specific binding affinity to EGFR (e.g., as expressed on a cancer cell) and the second binding domain has specific binding affinity to a CD3 (e.g., as expressed on an effector cell); the second portion comprises a release segment (RS) capable of being cleaved by a mammalian protease; and the third portion is a masking moiety that serves to mask the biological properties of the bispecific antibody domain. In some embodiments, the RS is a protease-cleavable release segment that is cleavable by a protease that is present in a tumor microenvironment.

In some embodiments in which the first portion comprises two binding domains that each comprise a VL and VH, the first portion binding domains can be in the order (VL-VH) 1-(VL-VH)2, wherein "1" and "2" represent the first and second binding domains, respectively, or (VL-VH) 1-(VH-VL)2, or (VH-VL) 1-(VL-VH)2, or (VH-VL) 1-(VH-VL)2, wherein the paired binding domains are linked by a polypeptide linker (e.g., as described herein).

In some embodiments, the domain that binds EGFR is an scFv comprising a VH and a VL.

In some embodiments, the first portion binding domains comprise sequences provided in Tables 5a-5f, wherein Tables 5a-5e show sequences that bind CD3 and Table 5f show sequences that bind to EGFR; the RS sequence comprises a sequence provided in Tables 7a-7b (e.g., as described herein); and the masking moiety is an ELNN. In some embodiments, the masking moiety is an ELNN having at least about 90%, 91%, 92%, 93%, 94%, 95%, 96%, 97%, 98%, 99%, or 100% sequence identity to a sequence comprising the group of sequences set forth in Tables 3a-3b. In some embodiments, the composition is a recombinant fusion protein. In some embodiments, the portions are linked by chemical conjugation.

In some embodiments, the fusion protein comprises the configuration of Formula IIa (depicted N-terminus to C-terminus):

(third portion)-(second portion)-(first portion)          (IIa)

wherein first portion is a bispecific comprising two antigen binding domains wherein the first binding domain has specific binding affinity to a EGFR (e.g., as expressed on a cancer cell) and the second binding domain has specific binding affinity to CD3 (e.g., as expressed on an effector cell); the second portion comprises a release segment (RS) capable of being cleaved by a mammalian protease; and the third portion is a masking moiety that serves to mask the biological properties of the bispecific antibody domain. In some embodiments, the RS is a protease-cleavable release segment that is universally cleavable in a tumor microenvironment.

In some embodiments in which the first portion comprises two binding domains that each comprise a VL and VH, the first portion binding domains can be in the order (VL-VH) 1-(VL-VH)2, wherein "1" and "2" represent the first and second binding domains, respectively, or (VL-VH) 1-(VH-VL)2, or (VH-VL) 1-(VL-VH)2, or (VH-VL) 1-(VH-VL)2, wherein the paired binding domains are linked by a polypeptide linker (e.g., as described herein).

In some embodiments, the domain that binds EGFR is an scFv comprising a VH and a VL.

In some embodiments, the first portion binding domains comprise sequences provided in Tables 5a-6f, wherein Tables 5a-e show sequences that bind CD3 and Table 5f shows sequences that bind to EGFR; the RS sequence comprises a sequence provided in Tables 7a-7b (e.g., as described herein); and the masking moiety is an ELNN. In some embodiments, the masking moiety is an ELNN having at least about 90%, 91%, 92%, 93%, 94%, 95%, 96%, 97%, 98%, 99%, or 100% sequence identity to a sequence comprising the group of sequences set forth in Tables 3a-3b. In some embodiments, the composition is a recombinant fusion protein. In some embodiments, the portions are linked by chemical conjugation.

In some embodiments, a paTCE composition comprises the configuration of Formula IIIa (depicted N-terminus to C-terminus):

(fifth portion)-(fourth portion)-(first portion)-(second portion)-(third portion)          (IIIa)

wherein first portion is a bispecific comprising two antigen binding domains wherein the first binding domain has specific binding affinity to a EGFR (e.g., as expressed on a cancer cell) and the second binding domain has specific binding affinity to CD3 (e.g., as expressed on an effector cell); the second portion comprises a release segment (RS) capable of being cleaved by a mammalian protease; and the third portion is a masking moiety that serves to mask the biological properties of the bispecific antibody domain; the fourth portion comprises a release segment (RS) capable of being cleaved by a mammalian protease which may be identical or different from the second portion; and the fifth portion is a masking moiety that may be identical or may be different from the third portion.

In some embodiments in which the first portion comprises two binding domains that each comprise a VL and VH, the first portion binding domains can be in the order (VL-VH) 1-(VL-VH)2, wherein "1" and "2" represent the first and second binding domains, respectively, or (VL-VH) 1-(VH-VL)2, or (VH-VL) 1-(VL-VH)2, or (VH-VL) 1-(VH-VL)2, wherein the paired binding domains are linked by a polypeptide linker (e.g., as described herein).

In some embodiments, the domain that binds EGFR is an scFv comprising a VH and a VL.

In some embodiments, the first portion binding domains comprise sequences provided in Tables 5a-5f, wherein Tables 5a-5e show sequences that bind CD3 and Table 5f shows sequences that bind to EGFR; each RS sequence comprises, individually, a sequence provided in Tables 7a-7b (e.g., as described herein); and each masking moiety is, individually, an ELNN. In some embodiments, each masking moiety is an ELNN having at least about 90%, 91%, 92%, 93%, 94%, 95%, 96%, 97%, 98%, 99%, or 100% sequence identity to a sequence comprising the group of sequences set forth in Tables 3a-3b. In some embodiments, the paTCE is a recombinant fusion protein. In some embodiments, one or more portions of the paTCE are linked by chemical conjugation.

Provided herein are compositions that advantageously provide EGFR-targeted bispecific therapeutics that have more selectivity, greater half-life, and result in less toxicity and fewer side effects once they are cleaved by proteases found in the target tissues or tissues rendered unhealthy by a disease, such that the subject compositions have improved therapeutic index compared to bispecific antibody compositions known in the art. Such compositions are useful in the treatment of cancer. In some embodiments, when a paTCE is in proximity to a target tissue or cell bearing or secreting a protease capable of cleaving the RS, the bispecific binding domains are liberated from the ELNN(s) by the action of protease(s), removing a steric hindrance barrier, and rendering the TCE freer to exert its pharmacologic effect. This property is particularly advantageous in treating immunologically cold tumors that express EGFR. In some embodiments, a paTCE provided herein is activated at in a target tissue, wherein the target tissue is a solid tumor of an organ or system.

Binding Domains

In some embodiments, a binding domain provided herein comprises one or more full-length antibodies or one or more antigen-binding fragments thereof. Antigen-binding fragments of antibodies include any naturally occurring, enzymatically obtainable, synthetic, or genetically engineered polypeptides comprising a portion or portions of an antibody that specifically bind to an antigen. Antigen-binding fragments of an antibody may be derived, e.g., from full antibody molecules using any suitable standard techniques, such as proteolytic digestion or recombinant genetic engineering techniques involving the manipulation and expression of DNA encoding antibody variable and optionally constant domains. The terms binding domain and antibody domain are used interchangeably herein.

In some embodiments, single chain binding domains are used, such as but not limited to Fv, Fab, Fab', Fab'-SH, F(ab')2, linear antibodies, single domain antibodies, VHHs, single-chain antibody molecules (scFv), and diabodies capable of binding ligands or receptors associated with effector cells and antigens of diseased tissues or cells that are cancers, tumors, or other malignant tissues.

In some embodiments, the binding domain is a bispecific antibody domain, wherein the bispecific antibody domain comprises a first antigen binding domain that specifically binds to a first target and a second antigen binding domain that specifically binds to a second target. In some embodiments, the first antigen binding domain is a first antigen binding fragment (e.g., an scFv or an ISVD, such as a VHH) and the second antigen binding domain is a second antigen binding fragment (e.g., an scFv or an ISVD, such as a VHH).

In some embodiments, an antigen binding fragment (AF) (e.g., a first antigen binding fragment (AF1), and/or a second antigen binding fragment (AF2)) can (each independently) be a chimeric, a humanized, or a human antigen-binding fragment. The antigen binding fragment (AF) (e.g., a first antigen binding fragment (AF1), and/or a second antigen binding fragment (AF2)) can (each independently) be an Fv, Fab, Fab', Fab'-SH, linear antibody, VHH, or scFv.

In some embodiments, one or both antigen binding fragments (e.g., the first and/or second antigen binding fragments) can be configured as an (Fab')2 or a single chain diabody. In some embodiments, the bispecific antibody comprises a first binding domain with binding specificity to a cancer cell marker and a second binding domain with binding specificity to an effector cell antigen. In some embodiments, the binding domain for the tumor cell target is a variable domain of a T cell receptor that has been engineered to bind MHC that is loaded with a peptide fragment of a protein that is overexpressed by tumor cells.

In some embodiments, a paTCE is designed with consideration of the location of the target tissue protease as well as the presence of the same protease in healthy tissues not intended to be targeted, as well as the presence of the target ligand in healthy tissue but a greater presence of the ligand in unhealthy target tissue, in order to provide a wide therapeutic window. A "therapeutic window" refers to the difference between the minimal effective dose and the maximal tolerated dose for a given therapeutic composition. In some embodiments, to help achieve a wide therapeutic window for a TCE, the binding domains of the TCE are shielded by the proximity of a masking (e.g., ELNN) moiety or moieties such that the binding affinity of the intact composition for one, or both, of the ligands is reduced compared to the composition that has been cleaved by a mammalian protease, thereby releasing the first portion from the shielding effects of the masking moiety.

In some embodiments, a complete antigen recognition and binding site comprises a dimer of one heavy chain variable domain (VH) and one light chain variable domain (VL). Within each VH and VL chain are three complementarity determining regions (CDRs) that interact to define an antigen binding site on the surface of the VH-VL dimer; the six CDRs of a binding domain confer antigen binding specificity to the antibody or single chain binding domain. Framework sequences flanking the CDRs have a tertiary structure that is essentially conserved in native immunoglobulins across species, and the framework residues (FR) serve to hold the CDRs in their appropriate orientation. In some embodiments, a constant domain is not required for binding function but may aid in stabilizing VH-VL interaction. In some embodiments, a binding site can be a pair of VH-VL, VH—VH or VL-VL domains either of the same or of different immunoglobulins, however it is generally preferred to make single chain binding domains using the respective VH and VL chains from the parental antibody. In some embodiments, the order of VH and VL domains within the polypeptide chain is not limiting, provided the VH and VL domains are arranged so that the antigen binding site can properly fold. Thus, in some embodiments, a single chain binding domains comprising a VH and a VL (e.g., in an scFv) can have the VH and VL arranged as VL-VH or VL-VH.

In some embodiments, the arrangement of the V chains may be VH (cancer cell surface antigen)-VL(cancer cell surface antigen)-VL(effector cell antigen)-VH (effector cell antigen), VH (cancer cell surface antigen)-VL(cancer cell surface antigen)-VH (effector cell antigen)-VL(effector cell antigen), VL(cancer cell surface antigen)-VH (cancer cell surface antigen)-VL(effector cell antigen)-VH (effector cell antigen), VL(cancer cell surface antigen)-VH (cancer cell surface antigen)-VH (effector cell antigen)-VL(effector cell antigen), VHH (cancer cell surface antigen)-VH (effector cell antigen)-VL(effector cell antigen), VHH (cancer cell surface antigen)-VL(effector cell antigen)-VH (effector cell antigen), VL(cancer cell surface antigen)-VH (cancer cell surface antigen)-VHH (effector cell antigen), or VH (cancer cell surface antigen)-VL(cancer cell surface antigen)-VHH (effector cell antigen).

In some embodiments, the following orders are possible: VH (effector cell antigen)-VL(effector cell antigen)-VL (cancer cell surface antigen)-VH (cancer cell surface antigen), VH (effector cell antigen)-VL(effector cell antigen)-VH (cancer cell surface antigen)-VL(cancer cell surface antigen), VL(effector cell antigen)-VH (effector cell antigen)-VL(cancer cell surface antigen)-VH (cancer cell surface antigen), VL(effector cell antigen)-VH (effector cell antigen)-VH (cancer cell surface antigen)-VL(cancer cell surface antigen), VHH (effector cell antigen)-VH (cancer cell surface antigen)-VL(cancer cell surface antigen), VHH (effector cell antigen)-VL(cancer cell surface antigen)-VH (cancer cell surface antigen), VL(effector cell antigen)-VH (effector cell antigen)-VHH (cancer cell surface antigen), or VH (effector cell antigen)-VL(effector cell antigen)-VHH (cancer cell surface antigen).

As used herein. "N-terminally to" or "C-terminally to" and grammatical variants thereof denote relative location within the primary amino acid sequence rather than placement at the absolute N- or C-terminus of the bispecific single chain antibody. Hence, as a non-limiting example, a first binding domain which is "located C-terminally to" a second binding domain denotes that the first binding is located on the carboxyl side of the second binding domain within a bispecific single chain antibody, and does not exclude the possibility that an additional sequence, for example a linker and/or an ELNN, a His-tag, or another compound such as a radioisotope, is located at the C-terminus of the bispecific single chain antibody.

In some embodiments, a paTCE comprises a first portion comprising a first binding domain and a second binding domain wherein each of the binding domains is an scFv and wherein each scFv comprises one VL and one VH. In some embodiments, the first binding domain is an scFv that binds CD3 and the second binding domain is an scFv that binds EGFR. In some embodiments, the paTCE compositions comprise a first portion comprising a first binding domain and a second binding domain wherein one of the binding domains is an scFV and the other binding domain is a VHH. In some embodiments, a paTCE comprises a first portion comprising a first binding domain and a second binding domain wherein the binding domains are in a diabody configuration and wherein one domain comprises one VL region and one VH region and the other domain comprises one VL region and one VH region. Exemplary VH and VL of CD3-binding domains are shown in Tables 5a-5e. Exemplary VH and VL of EGFR-binding domains are shown in Table 5f.

In non-limiting examples, a TCE can comprise a sequence that exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to an antibody sequence identified herein. In some embodiments, a TCE comprises a bispecific sequence (e.g., a BsAb) comprising a first binding domain and a second binding domain, wherein the first binding domain has specific binding affinity to a tumor-specific marker or a cancer cell antigen, and exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-EGFR antibody disclosed herein in Table 5f; and wherein the second binding domain has specific binding affinity to an effector cell, and exhibits at least about 80% sequence identity, or alternatively 81%, 82%, 83%, 84%, 85%, 86%, 87%, 88%, 89%, 90%, 91%, 92%, 93%, 94%, 95%, 96%, 97%, 98%, 99%, or 100% sequence identity to paired VL and VH sequences of an anti-CD3 antibody disclosed herein in any of Tables 5a-5e.

In some embodiments, a TCE can comprise a binding domain (e.g., a VH and/or VL amino acid sequence) of or derived from an anti-CD3 antibody. Non-limiting examples of anti-CD3 antibodies include OKT3 (also called muromonab) and humanized anti-CD3 monoclonal antibody (hOKT31 (Ala-Ala)) (KC Herold et al., New England Journal of Medicine 346:1692-1698. 2002), as well as fragments and derivatives thereof that selectively bind to CD3. Additional examples are described in U.S. Pat. Nos. 5,885,573; 6,491,916; and US Patent Application Publication No. 2021/0054077-A1, the entire contents of each of which are incorporated herein by reference. Additional non-limiting examples of anti-CD3 antibody sequences include those of pasotuxizumab (also known as AMG-212) and acapatamab (also known as AMG-160).

In some embodiments, a TCE can comprise a binding domain (e.g., a VH and/or VL amino acid sequence) of or derived from an anti-EGFR antibody. Non-limiting examples of anti-EGFR antibody sequences include those of panitumumab and cetuximab.

The present disclosure provides antigen binding domains that bind EGFR. The present disclosure provides scFvs that bind EGFR (e.g., an scFv having a paired VH and VL of Table 5f). The present disclosure further provides nucleic acids encoding the antigen binding domains (e.g., scFvs) or polypeptides as well as vectors, hosts and methods to produce these antigen binding domains or polypeptides. Also provided are multispecific polypeptides comprising an antigen binding domain that binds EGFR according to the present disclosure and at least one CD3 binding domain, including paTCEs. Included are methods for treatment making use of the antigen binding domains or polypeptides according to the present disclosure.

Also provided is a nucleic acid molecule encoding the antigen binding domains (e.g., an scFv) or polypeptide of the present disclosure or a vector comprising the nucleic acid.

The present disclosure also relates to a non-human host or host cell transformed or transfected with the nucleic acid or vector that encodes an antigen binding domains (e.g., an scFv) or polypeptide disclosed herein.

The present disclosure furthermore relates to compositions comprising an antigen binding domains (e.g., an scFv) or polypeptide disclosed herein, such as a pharmaceutical composition.

Included herein is a method for producing an antigen binding domains (e.g., an scFv) or polypeptide as disclosed herein, the method comprising the steps of:

a. expressing, in a host cell or host organism or in another expression system, a nucleic acid sequence encoding the antigen binding domains (e.g., an scFv) or polypeptide; optionally followed by:

b. isolating and/or purifying the antigen binding domains (e.g., an scFv) or polypeptide.

Provided herein are compositions and polypeptides comprising an antigen binding domains (e.g., an scFv) for use as a medicament. In some embodiments, the polypeptide or composition is for use in the treatment of a proliferative disease. In some embodiments, the proliferative disease is cancer.

The present disclosure also provides a method of treatment comprising the step of administering a composition or polypeptide comprising an antigen binding domains (e.g., an scFv) to a subject in need thereof. In some embodiments, the method of treatment is for treating a proliferative disease. In some embodiments, the proliferative disease is cancer.

Included herein are composition and polypeptides comprising an antigen binding domains (e.g., an scFv) for use in the preparation of a medicament. In some embodiments, the medicament is used in the treatment of a proliferative disease. In some embodiments, the proliferative disease is cancer.

In some embodiments, the structure of each of the VH or VL of an antigen binding domain (e.g., scFv) sequence can be considered to be comprised of four framework regions ("FRs"), which are referred to in the art and herein as "Framework region 1" ("FR1"); as "Framework region 2" ("FR2"); as "Framework region 3" ("FR3"); and as "Framework region 4" ("FR4"), respectively; which framework regions are interrupted by three complementary determining regions ("CDRs"), which are referred to in the art and herein as "Complementarity Determining Region 1" ("CDR1"); as "Complementarity Determining Region 2" ("CDR2"); and as "Complementarity Determining Region 3" ("CDR3"), respectively.

In some embodiments, technology provided herein uses antigen binding domains (e.g., scFvs) that can bind to EGFR. In the context of the present technology, "binding to"

a certain target molecule has the usual meaning in the art as understood in the context of antibodies and their respective antigens.

As will be clear from the further description above and herein, the antigen binding domain (e.g., scFv) of the present technology can be used as "building blocks" to form poly-peptides of the present technology, e.g., by suitably com-bining them with other groups, residues, moieties or binding units, in order to form compounds or fusion proteins as described herein (such as, without limitations, the bi-/tri-/tetra-/multivalent and bi-/tri-/tetra-/multispecific polypep-tides of the present technology described herein), which combine within one molecule one or more desired properties or biological functions.

The terms "specificity", "binding specifically" or "spe-cific binding" refer to the number of different target mol-ecules, such as antigens, from the same organism to which a particular binding unit, such as an antigen binding domain (e.g., scFv), can bind with sufficiently high affinity (see below). "Specificity", "binding specifically" or "specific binding" are used interchangeably herein with "selectivity", "binding selectively" or "selective binding". Binding units, such as scFvs, preferably specifically bind to their desig-nated targets.

The specificity/selectivity of a binding unit can be deter-mined based on affinity. The affinity denotes the strength or stability of a molecular interaction. The affinity is commonly given as by the $K_D$ which is expressed in units of mol/liter (or M).

The affinity is a measure for the binding strength between a moiety and a binding site on the target molecule: the lower the value of the $k_D$, the stronger the binding strength between a target molecule and a targeting moiety.

Typically, binding units used in the present technology (such as scFvs) will bind to their targets with a $k_D$ of $10^{-5}$ to $10^{-12}$ moles/liter or less, and preferably $10^{-7}$ to $10^{-12}$ moles/liter or less and more preferably $10^{-8}$ to $10^{-12}$ moles/liter.

In some embodiments, a $k_D$ value greater than $10^{-4}$ mol/liter is considered nonspecific. In some embodiments, a $k_D$ value less than $10^{-4}$ mol/liter is considered specific.

The $k_D$ for biological interactions, such as the binding of antibody sequences to an antigen, which are considered specific are typically in the range of 10000 nM or 10 µM to 0.001 nM or 1 µM or less.

Accordingly, specific/selective binding may mean that-using the same measurement method, e.g., SPR-a binding unit (or polypeptide comprising the same) binds to EGFR with a $k_D$ value of $10^{-5}$ to $10^{-12}$ moles/liter or less and binds to different targets with a $k_D$ value greater than $10^{-4}$ moles/liter.

Specific binding to a certain target from a certain species does not exclude that the binding unit can also specifically bind to the analogous target from a different species. For example, specific binding to human EGFR does not exclude that the binding unit (or a polypeptide comprising the same) can also specifically bind to EGFR from cynomolgus mon-keys.

Specific binding of a binding unit to its designated target can be determined in any suitable manner known per se, including, for example, Scatchard analysis and/or competi-tive binding assays, such as radioimmunoassays (RIA), enzyme immunoassays (EIA) and sandwich competition assays, and the different variants thereof known per se in the art; as well as the other techniques mentioned herein.

The dissociation constant may be, e.g., the actual or apparent dissociation constant, as will be clear to the skilled person. Methods for determining the dissociation constant will be clear to the skilled person, and for example include the techniques mentioned below.

The affinity of a molecular interaction between two mol-ecules can be measured via different techniques known per se, such as the well-known surface plasmon resonance (SPR) biosensor technique (see for example Ober et al. 2001, Intern. Immunology 13:1551-1559). The term "sur-face plasmon resonance", as used herein, refers to an optical phenomenon that allows for the analysis of real-time bio-specific interactions by detection of alterations in protein concentrations within a biosensor matrix, where one mol-ecule is immobilized on the biosensor chip and the other molecule is passed over the immobilized molecule under flow conditions yielding $k_{on}$, $k_{off}$ measurements and hence $k_D$ values. This can for example be performed using the well-known BIAcore® system (BIAcore International AB, a GE Healthcare company, Uppsala, Sweden and Piscataway, NJ). For further descriptions, see Jonsson et al. (1993, Ann. Biol. Clin. 51:19-26), Jonsson et al. (1991 Biotechniques 11:620-627), Johnsson et al. (1995, J. Mol. Recognit. 8:125-131), and Johnnson et al. (1991, Anal. Biochem. 198:268-277).

Another well-known biosensor technique to determine affinities of biomolecular interactions is bio-layer interfer-ometry (BLI) (see for example Abdiche et al. 2008, Anal. Biochem. 377:209-217). The term "bio-layer Interferom-etry" or "BLI", as used herein, refers to a label-free optical technique that analyzes the interference pattern of light reflected from two surfaces: an internal reference layer (reference beam) and a layer of immobilized protein on the biosensor tip (signal beam). A change in the number of molecules bound to the tip of the biosensor causes a shift in the interference pattern, reported as a wavelength shift (nm), the magnitude of which is a direct measure of the number of molecules bound to the biosensor tip surface. Since the interactions can be measured in real-time, association and dissociation rates and affinities can be determined. BLI can for example be performed using the well-known Octet® Systems (ForteBio, a division of Pall Life Sciences, Menlo Park, USA).

Alternatively, affinities can be measured in Kinetic Exclu-sion Assay (KinExA) (see for example Drake et al. 2004, Anal. Biochem., 328:35-43), using the KinExAR platform (Sapidyne Instruments Inc, Boise, USA). The term "KinExA", as used herein, refers to a solution-based method to measure true equilibrium binding affinity and kinetics of unmodified molecules. Equilibrated solutions of an anti-body/antigen complex are passed over a column with beads precoated with antigen (or antibody), allowing the free antibody (or antigen) to bind to the coated molecule. Detec-tion of the antibody (or antigen) thus captured is accom-plished with a fluorescently labeled protein binding the antibody (or antigen).

The GYROLAB® immunoassay system provides a plat-form for automated bioanalysis and rapid sample turnaround (Fraley et al. 2013, Bioanalysis 5:1765-74).

In some embodiments, a paTCE comprises a first binding domain that is an scFv and a second binding domain that is an scFv. In some embodiments, the first scFv comprises VL and VH domains and specificity binds to an effector cell antigen (such as CD3), and the second scFv specifically binds a cancer cell antigen (such as EGFR). In some embodiments, the scFv comprises six CDRs. In some embodiments, the scFv that comprises VH and VL regions comprising amino acid sequences that are at least about 90%, or 91%, or 92%, or 93%, or 94%, or 95%, or 96%, or 97%, or 98%, or 99% identical to, or are identical to, paired VL and VH sequences of an anti-CD3 antibody identified in Table 5a. In some embodiments, the scFv comprises a CDR-H1 region, a CDR-H2 region, a CDR-H3 region, a CDR-L1 region, a CDR-L2 region, and a CDR-L3 region of paired VL and VH sequences of an anti-CD3 antibody identified in Table 5a. In some embodiments, the scFv is derived from an anti-EGFR antibody identified as the antibodies set forth in Table 5f. In some embodiments, the scFv comprises VH and VL regions comprising amino acid sequences that are at least about 90%, or 91%, or 92%, or 93%, or 94%, or 95%, or 96%, or 97%, or 98%, or 99% identical to, or is identical to, a VH and VL sequence disclosed in Table 5f. In some embodiments, the VH and VL comprise a CDR-1 region, a CDR-2 region, and a CDR-3 region of a VH and VL sequence in Table 5f.

In some embodiments, a paTCE comprises a first binding domain that is an scFv and a second binding domain that is also an scFv. In some embodiments, the scFvs comprise VL and VH domains that are derived from monoclonal antibodies with binding specificity to the tumor-specific marker or an antigen of a cancer cell and effector cell antigen, respectively. In some embodiments, the first and second binding domains each comprise six CDRs derived from monoclonal antibodies with binding specificity to a cancer cell marker, such as a tumor-specific marker and effector cell antigens, respectively. In some embodiments, the first and second binding domains of the first portion of the subject compositions can have 3, 4, 5, or 6 CDRs within each binding domain. In some embodiments, a paTCE comprises a first binding domain and a second binding domain wherein each comprises a CDR-H1 region, a CDR-H2 region, a CDR-H3 region, a CDR-L1 region, a CDR-L2 region, and a CDR-L3 region, wherein each of the regions is derived from a monoclonal antibody capable of binding a tumor-specific marker or an antigen of a cancer cell, and an effector cell antigen, respectively.

In some embodiments, the second binding domain comprises VH and VL regions derived from a monoclonal antibody capable of binding human CD3. In some embodiments, the second binding domain comprises a scFv that comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of an anti-CD3 antibody identified in Table 5a. In some embodiments, the second domain comprises a CDR-H1 region, a CDR-H2 region, a CDR-H3 region, a CDR-L1 region, a CDR-L2 region, and a CDR-L3 region, wherein each of the regions is derived from a monoclonal antibody identified herein as the antibodies set forth in Table 5a. In some embodiments, the VH and/or VL domains can be configured as scFvs or diabodies.

In some embodiments, a paTCE comprises a first binding domain that is a diabody and a second binding domain that is also a diabody. In some embodiments, the diabodies comprise VL and VH domains that are derived from monoclonal antibodies with binding specificity to the tumor-specific marker or an antigen of a cancer cell and the effector cell antigen, respectively.

In some embodiments, the present disclosure provides a paTCE composition, wherein the diabody second binding domain comprises VH and VL regions wherein each of the VH and VL regions exhibits at least about 90%, or 91%, or 92%, or 93%, or 94%, or 95%, or 96%, or 97%, or 98%, or 99% identity to or is identical to the VL and a VH sequence of the huUCHT1 antibody of Table 5a. In some embodiments, the diabody second domain of the composition is derived from an anti-CD3 antibody described herein. In some embodiments, the anti-CD3 diabody is linked to an anti-EGFR-binding scFv sequence disclosed herein.

Methods to measure binding affinity and/or other biologic activity of an antigen binding domain can be those disclosed herein or methods generally known in the art. For example, the binding affinity of a binding pair (e.g., antibody and antigen), denoted as $k_D$, can be determined using various suitable assays including, but not limited to, radioactive binding assays, non-radioactive binding assays such as fluorescence resonance energy transfer and surface plasmon resonance (SPR, Biacore), and enzyme-linked immunosorbent assays (ELISA), kinetic exclusion assay (KinExA®) or as described in the Examples. An increase or decrease in binding affinity, for example the increased binding affinity of a TCE that has been cleaved to remove a masking moiety compared to the paTCE with the masking moiety attached, can be determined by measuring the binding affinity of the TCE to its target binding partner with and without the masking moiety.

Measurement of half-life of a subject chimeric assembly can be performed by various suitable methods. For example, the half-life of a substance can be determined by administering the substance to a subject and periodically sampling a biological sample (e.g., biological fluid such as blood or plasma or ascites) to determine the concentration and/or amount of that substance in the sample over time. The concentration of a substance in a biological sample can be determined using various suitable methods, including enzyme-linked immunosorbent assays (ELISA), immunoblots, and chromatography techniques including high-pressure liquid chromatography and fast protein liquid chromatography. In some cases, the substance may be labeled with a detectable tag, such as a radioactive tag or a fluorescence tag, which can be used to determine the concentration of the substance in the sample (e.g., a blood sample or a plasma sample. The various pharmacokinetic parameters are then determined from the results, which can be done using software packages such as SoftMax Pro software, or by manual calculations known in the art.

In addition, the physicochemical properties of the paTCE compositions may be measured to ascertain the degree of solubility, structure, and retention of stability. Assays of the subject compositions are conducted that allow determination of binding characteristics of the binding domains towards a ligand, including affinity and binding constants ($k_D$, $k_{on}$ and $k_{off}$), the half-life of dissociation of the ligand-receptor complex, as well as the activity of the binding domain to inhibit the biologic activity of the sequestered ligand compared to free ligand ($IC_{50}$ values). The term "$EC_{50}$" refers to the concentration needed to achieve half of the maximum biological response of the active substance, and is generally determined by ELISA or cell-based assays, including the methods of the Examples described herein.

Anti-CD3 Binding Domains

Also provided are anti-CD3 antibodies, fragments thereof, and fusion proteins comprising such antibodies and/or fragments.

In some embodiments, the present disclosure provides paTCE compositions comprising a binding domain of a first portion with binding affinity to T cells. In some embodiments, the binding domain comprises VL and VH derived from a monoclonal antibody that binds CD3. In some embodiments, the binding domain comprises VL and VH derived from a monoclonal antibody to CD3 epsilon and/or CD3 delta. In some embodiments, the binding domain comprises VL and VH derived from a monoclonal antibody to CD3 epsilon. In some embodiments, the binding domain comprises VL and VH derived from a monoclonal antibody to CD3 delta. Exemplary, non-limiting examples of VL and VH sequences of monoclonal antibodies to CD3 are presented in Table 5a. In some embodiments, the present disclosure provides a paTCE comprising a binding domain with binding affinity to CD3 comprising anti-CD3 VL and VH sequences set forth in Table 5a. In some embodiments, the present disclosure provides a paTCE comprising a binding domain of the first portion with binding affinity to CD3epsilon comprising anti-CD3epsilon VL and VH sequences set forth in Table 5a. In some embodiments, the present disclosure provides a paTCE composition, wherein a binding domain of the first portion comprises an scFv that comprises VH and VL regions wherein each VH and VL regions exhibit at least about 90%, or 91%, or 92%, or 93%, or 94%, or 95%, or 96%, or 97%, or 98%, or 99% identity to or is identical to paired VL and VH sequences of the huUCHT1 anti-CD3 antibody of Table 5a. In some embodiments, the present disclosure provides a paTCE composition comprising a binding domain with binding affinity to CD3 comprising the CDR-L1 region, the CDR-L2 region, the CDR-L3 region, the CDR-H1 region, the CDR-H2 region, and the CDR-H3 region, wherein each is derived from the respective anti-CD3 VL and VH sequences set forth in Table 5a. In some embodiments, the present disclosure provides a paTCE composition comprising a binding domain with binding affinity to CD3 comprising an CDR-L1 region of RSSNGAVTSSNYAN (SEQ ID NO: 1), an CDR-L2 region of GTNKRAP (SEQ ID NO: 4), an CDR-L3 region of ALWYPNLWV (SEQ ID NO: 6), an CDR-H1 region of GFTFSTYAMN (SEQ ID NO: 12), an CDR-H2 region of RIRTKRNNYATYYADSVKG (SEQ ID NO: 13), and an CDR-H3 region of HENFGNSYVSWFAH (SEQ ID NO: 10). In some embodiments, the present disclosure provides a paTCE composition comprising a binding domain with binding affinity to CD3 comprising an CDR-L1 region of RSSNGAVTSSNYAN (SEQ ID NO: 1), an CDR-L2 region of GTNKRAP (SEQ ID NO: 4), an CDR-L3 region of ALWYPNLWV (SEQ ID NO: 6), an CDR-H1 region of GFTFSTYAMN (SEQ ID NO: 12), an CDR-H2 region of RIRTKRNDYATYYADSVKG (SEQ ID NO: 14), and an CDR-H3 region of HENFGNSYVSWFAH (SEQ ID NO: 10).

The CD3 complex is a group of cell surface molecules that associates with the T-cell antigen receptor (TCR) and functions in the cell surface expression of TCR and in the signaling transduction cascade that originates when a peptide: MHC ligand binds to the TCR. Without being bound by any scientific theory, typically, when an antigen binds to the T-cell receptor, the CD3 sends signals through the cell membrane to the cytoplasm inside the T cell. This causes activation of the T cell that rapidly divide to produce new T cells sensitized to attack the particular antigen to which the TCR was exposed. The CD3 complex is comprised of the CD3epsilon molecule, along with four other membrane-bound polypeptides (CD3-gamma, -delta, and/or -zeta). In humans, CD3-epsilon is encoded by the CD3E gene on Chromosome 11. The intracellular domains of each of the CD3 chains contain immunoreceptor tyrosine-based activation motifs (ITAMs) that serve as the nucleating point for the intracellular signal transduction machinery upon T cell receptor engagement.

A number of therapeutic strategies modulate T cell immunity by targeting TCR signaling, particularly the anti-human CD3 monoclonal antibodies (mAbs) that are widely used clinically in immunosuppressive regimes. The CD3-specific mouse mAb OKT3 was the first mAb licensed for use in humans (Sgro, C. Side-effects of a monoclonal antibody, muromonab CD3/orthoclone OKT3: bibliographic review. Toxicology 105:23-29. 1995) and is widely used clinically as an immunosuppressive agent in transplantation (Chatenoud, Clin. Transplant 7:422-430, (1993); Chatenoud, Nat. Rev. Immunol. 3:123-132 (2003); Kumar, Transplant. Proc. 30:1351-1352 (1998)), type 1 diabetes, and psoriasis. Importantly, anti-CD3 mAbs can induce partial T cell signaling and clonal anergy (Smith, JA, Nonmitogenic Anti-CD3 Monoclonal Antibodies Deliver a Partial T Cell Receptor Signal and Induce Clonal Anergy J. Exp. Med. 185:1413-1422 (1997)). OKT3 has been described in the literature as a T cell mitogen as well as a potent T cell killer (Wong, JT. The mechanism of anti-CD3 monoclonal antibodies. Mediation of cytolysis by inter-T cell bridging. Transplantation 50:683-689 (1990)). In particular, the studies of Wong demonstrated that by bridging CD3 T cells and target cells, one could achieve killing of the target and that neither FcR-mediated ADCC nor complement fixation was necessary for bivalent anti-CD3 MAB to lyse the target cells.

OKT3 exhibits both a mitogenic and T-cell killing activity in a time-dependent fashion; following early activation of T cells leading to cytokine release, upon further administration OKT3 later blocks all known T-cell functions. It is due to this later blocking of T cell function that OKT3 has found such wide application as an immunosuppressant in therapy regimens for reduction or even abolition of allograft tissue rejection. Other antibodies specific for the CD3 molecule are disclosed in Tunnacliffe, Int. Immunol. 1 (1989), 546-50, WO2005/118635 and WO2007/033230 describe anti-human monoclonal CD3 epsilon antibodies, U.S. Pat. No. 5,821, 337 describes the VL and VH sequences of murine anti-CD3 monoclonal Ab UCHT1 (muxCD3, Shalaby et al., J. Exp. Med. 175, 217-225 (1992) and a humanized variant of this antibody (hu UCHT1), and U.S. patent application No. 20120034228 discloses binding domains capable of binding to an epitope of human and non-chimpanzee primate CD3 epsilon chain.

In some embodiments, an anti-CD3 antibody domain comprises a VH region comprising the sequence EVOLVESGGGIVQPGGSLRLSCAASGFTF-STYAMNWVRQAPGKGLEWVGRIRTKRNNYATYYA DSVKGRFTISRDDSKNTVYLQMNSLKTED-TAVYYCVRHENFGNSYVSWFAHWGQGTLVTVSS (SEQ ID NO: 311), or the CDRs thereof, and a VL region comprising the sequence ELVVTQEPSLTVSPGGTVTLT-CRSSNGAVTSSNYANWVQQKPGQAPRGLIGGTNK-RAPGTPARF SGSLLGGKAALTLSGVQPEDEAVYY-CALWYPNLWVFGGGTKLTVL (SEQ ID NO: 361), or the CDRs thereof.

In some embodiments, an anti-CD3 antibody domain comprises a VH region comprising the sequence EVOLVESGGGIVQPGGSLRLSCAASGFTF-STYAMNWVRQAPGKGLEWVGRIRTKRNDYATYYA DSVKGRFTISRDDSKNTLYLQMNSLKTED-TAVYYCVRHENFGNSYVSWFAHWGQGTLVTVSS (SEQ ID NO: 126), or the CDRs thereof, and a VL region comprising the sequence ELVVTQEPSLTVSPGGTVTLT-CRSSNGAVTSSNYANWVQQKPGQAPRGLIGGTNK-RAPGTPARF SGSLLEGKAALTLSGVQPEDEAVYY-CALWYPNLWVFGGGTKLTVL (SEQ ID NO: 127), or the CDRs thereof.

TABLE 5a

| | | | | SEQ ID | | SEQ ID |
|---|---|---|---|---|---|---|
| Clone Name | Antibody Name | Target | VH Sequence | NO. | VL Sequence | NO. |
| huOKT3 | | CD3 | QVQLVQSGGGVVQP GRSLRLSCKASGYT FTRYTMHWVRQAP GKGLEWIGYINPSR GYTNYNQKVKDRF TISRDNSKNTAFLQ MDSLRPEDTGVYFC ARYYDDHYCLDYW GQGTPVTVSS | 301 | DIQMTQSPSSLSASV GDRVTITCSASSSVS YMNWYQQTPGKAP KRWIYDTSKLASGV PSRFSGSGSGTDYTF TISSLQPEDIATYYC QQWSSNPFTFGQGT KLQITR | 351 |
| huUCHT1 | | CD3 | EVQLVESGGGLVQP GGSLRLSCAASGYS FTGYTMNWVRQAP GKGLEWVALINPYK GVSTYNQKFKDRFT ISVDKSKNTAYLQM NSLRAEDTAVYYCA RSGYYGDSDWYFD VWGQGTLVTVSS | 302 | DIQMTQSPSSLSASV GDRVTITCRASQDIR NYLNWYQQKPGKA PKLLIYYTSRLESGV PSRFSGSGSGTDYTL TISSLQPEDFATYYC QQGNTLPWTFGQG TKVEIK | 352 |
| hu12F6 | | CD3 | QVQLVQSGGGVVQP GRSLRLSCKASGYT FTSYTMHWVRQAP GKGLEWIGYINPSS GYTKYNQKFKDRF TISADKSKSTAFLQM DSLRPEDTGVYFCA RWQDYDVYFDYW GQGTPVTVSS | 303 | DIQMTQSPSSLSASV GDRVTMTCRASSSV SYMHWYQQTPGKA PKPWIYATSNLASG VPSRFSGSGSGTDYT LTISSLQPEDIATYYC QQWSSNPPTFGQGT KLQITR | 353 |
| mOKT3 | | CD3 | QVQLQQSGAELARP GASVKMSCKASGY TFTRYTMHWVKQR PGQGLEWIGYINPSR GYTNYNQKFKDKA TLTTDKSSSTAYMQ LSSLTSEDSAVYYCA RYYDDHYCLDYWG QGTTLTVSS | 304 | QIVLTQSPAIMSASP GEKVTMTCSASSSV SYMNWYQQKSGTS PKRWIYDTSKLASG VPAHFRGSGSGTSYS LTISGMEAEDAATY YCQQWSSNPFTFGS GTKLEINR | 354 |
| MT103 | blinatumomab | CD3 | DIKLQQSGAELARP GASVKMSCKTSGYT FTRYTMHWVKQRP GQGLEWIGYINPSR GYTNYNQKFKDKA TLTTDKSSSTAYMQ LSSLTSEDSAVYYCA RYYDDHYCLDYWG QGTTLTVSS | 305 | DIQLTQSPAIMSASP GEKVTMTCRASSSV SYMNWYQQKSGTS PKRWIYDTSKVASG VPYRFSGSGSGTSYS LTISSMEAEDAATY YCQQWSSNPLTFG AGTKLELK | 355 |
| MT110 | solitomab | CD3 | DVQLVQSGAEVKKP GASVKVSCKASGYT FTRYTMHWVRQAP GQGLEWIGYINPSR GYTNYADSVKGRF TITTDKSTSTAYMEL SSLRSEDTATYYCA RYYDDHYCLDYWG QGTTVTVSS | 306 | DIVLTQSPATLSLSP GERATLSCRASQSV SYMNWYQQKPGKA PKRWIYDTSKVASG VPARFSGSGSGTDYS LTINSLEAEDAATY CQQWSSNPLTFGG GTKVEIK | 356 |
| CD3.7 | | CD3 | EVQLVESGGGLVQP GGSLKLSCAASGFT FNKYAMNWVRQAP GKGLEWVARIRSKY NNYATYYADSVKDRFTISRDDSKNTAYL QMNNLKTEDTAVY YCVRHGNFGNSYIS YWAYWGQGTLVTV SS | 307 | QTVVTQEPSLTVSPG GTVTLTCGSSTGAV TSGYYPNWVQQKP GQAPRGLIGGTKFL APGTPARFSGSLLGG KAALTLSGVQPEDE AEYYCALWYSNRW VFGGGTKLTVL | 357 |
| CD3.8 | | CD3 | EVQLVESGGGLVQP GGSLRLSCAASGFT FNTYAMNWVRQAP GKGLEWVGRIRSKY | 308 | QAVVTQEPSLTVSP GGTVTLTCGSSTGA VTTSNYANWVQQK PGQAPRGLIGGTNK | 358 |

TABLE 5a-continued

| Clone Name | Antibody Name | Target | VH Sequence | SEQ ID NO. | VL Sequence | SEQ ID NO. |
|---|---|---|---|---|---|---|
| | | | NNYATYYADSVKG<br>RFTISRDDSKNTLYL<br>QMNSLRAEDTAVY<br>YCVRHGNFGNSYV<br>SWFAYWGQGTLVT<br>VSS | | RAPGVPARFSGSLL<br>GGKAALTLSGAQPE<br>DEAEYYCALWYSN<br>LWVFGGGTKLTVL | |
| CD3.9 | | CD3 | EVQLLESGGGLVQP<br>GGSLKLSCAASGFT<br>FNTYAMNWVRQAP<br>GKGLEWVARIRSKY<br>NNYATYYADSVKD<br>RFTISRDDSKNTAYL<br>QMNNLKTEDTAVY<br>YCVRHGNFGNSYV<br>SWFAYWGQGTLVT<br>VSS | 309 | ELVVTQEPSLTVSPG<br>GTVTLTCRSSTGAV<br>TTSNYANWVQQKP<br>GQAPRGLIGGTNKR<br>APGTPARFSGSLLGG<br>KAALTLSGVQPEDE<br>AEYYCALWYSNLW<br>VFGGGTKLTVL | 359 |
| CD3.10 | | CD3 | EVKLLESGGGLVQP<br>KGSLKLSCAASGFT<br>FNTYAMNWVRQAP<br>GKGLEWVARIRSKY<br>NNYATYYADSVKD<br>RFTISRDDSQSILYLQ<br>MNNLKTEDTAMYY<br>CVRHGNFGNSYVS<br>WFAYWGQGTLVTV<br>SS | 310 | QAVVTQESALTTSP<br>GETVTLTCRSSTGA<br>VTTSNYANWVQEK<br>PDHLFTGLIGGTNK<br>RAPGVPARFSGSLIG<br>DKAALTITGAQTED<br>EAIYFCALWYSNLW<br>VFGGGTKLTVL | 360 |
| CD3.228 | | CD3 | EVQLVESGGGIVQP<br>GGSLRLSCAASGFT<br>FSTYAMNWVRQAP<br>GKGLEWVGRIRTK<br>RNNYATYYADSVK<br>GRFTISRDDSKNTVY<br>LQMNSLKTEDTAVY<br>YCVRHENFGNSYVS<br>WFAHWGQGTLVTV<br>SS | 311 | ELVVTQEPSLTVSPG<br>GTVTLTCRSSNGAV<br>TSSNYANWVQQKP<br>GQAPRGLIGGTNKR<br>APGTPARFSGSLLGG<br>KAALTLSGVQPEDE<br>AVYYCALWYPNLW<br>VFGGGTKLTVL | 361 |
| CD3.23 | | CD3 | EVQLLESGGGIVQPG<br>GSLKLSCAASGFTF<br>NTYAMNWVRQAPG<br>KGLEWVARIRSKYN<br>NYATYYADSVKDR<br>FTISRDDSKNTVYLQ<br>MNNLKTEDTAVYY<br>CVRHENFGNSYVS<br>WFAHWGQGTLVTV<br>SS | 102 | ELVVTQEPSLTVSPG<br>GTVTLTCRSSNGAV<br>TSSNYANWVQQKP<br>GQAPRGLIGGTNKR<br>APGTPARFSGSLLGG<br>KAALTLSGVQPEDE<br>AVYYCALWYPNLW<br>VFGGGTKLTVL | 101 |
| CD3.24 | | CD3 | EVQLLESGGGIVQPG<br>GSLKLSCAASGFTF<br>NTYAMNWVRQAPG<br>KGLEWVARIRSKYN<br>NYATYYADSVKDR<br>FTISRDDSKNTVYLQ<br>MNNLKTEDTAVYY<br>CVRHENFGNSYVS<br>WFAHWGQGTLVTV<br>SS | 102 | ELVVTQEPSLTVSPG<br>GTVTLTCRSSNGEV<br>TTSNYANWVQQKP<br>GQAPRGLIGGTIKR<br>APGTPARFSGSLLGG<br>KAALTLSGVQPEDE<br>AVYYCALWYPNLW<br>VFGGGTKLTVL | 103 |
| CD3.30 | | CD3 | EVQLQESGGGIVQP<br>GGSLKLSCAASGFT<br>FNTYAMNWVRQAP<br>GKGLEWVARIRSKY<br>NNYATYYADSVKD<br>RFTISRDDSKNTVYL<br>QMNNLKTEDTAVY<br>YCVRHENFGNSYVS<br>WFAHWGQGTLVTV<br>SS | 105 | ELVVTQEPSLTVSPG<br>GTVTLTCRSSNGAV<br>TSSNYANWVQQKP<br>GQAPRGLIGGTNKR<br>APGTPARFSGSSLGG<br>KAALTLSGVQPEDE<br>AVYYCALWYPNLW<br>VFGGGTKLTVL | 104 |
| CD3.31 | | CD3 | EVQLQESGGGIVQP<br>GGSLKLSCAASGFT | 105 | ELVVTQEPSLTVSPG<br>GTVTLTCRSSNGAV | 106 |

TABLE 5a-continued

Anti-CD3 Monoclonal Antibodies and Sequences

| Clone Name | Antibody Name | Target | VH Sequence | SEQ ID NO. | VL Sequence | SEQ ID NO. |
|------------|---------------|--------|-------------|------------|-------------|------------|
| | | | FNTYAMNWVRQAP GKGLEWVARIRSKY NNYATYYADSVKD RFTISRDDSKNTVYL QMNNLKTEDTAVY YCVRHENFGNSYVS WFAHWGQGTLVTV SS | | TSSNYANWVQQKP GQAPRGLIGGTNKR APGTPARFSGSLLGG SAALTLSGVQPEDE AVYYCALWYPNLW VFGGGTKLTVL | |
| CD3.32 | | CD3 | EVQLQESGGGIVQP GGSLKLSCAASGFT FNTYAMNWVRQAP GKGLEWVARIRSKY NNYATYYADSVKD RFTISRDDSKNTVYL QMNNLKTEDTAVY YCVRHENFGNSYVS WFAHWGQGTLVTV SS | 105 | ELVVTQEPSLTVSPG GTVTLTCRSSNGAV TSSNYANWVQQKP GQAPRGLIGGTNKR APGTPARFSGSSLGG SAALTLSGVQPEDE AVYYCALWYPNLW VFGGGTKLTVL | 107 |
| CD3.33 | | CD3 | EVQLQESGGGLVQP GGSLKLSCAASGFT FNTYAMNWVRQAP GKGLEWVARIRSKY NNYATYYADSVKD RFTISRDDSKNTAYL QMNNLKTEDTAVY YCVRHGNFGNSYV SWFAYWGQGTLVT VSS | 111 | ELVVTQEPSLTVSPG GTVTLTCRSSTGAV TTSNYANWVQQKP GQAPRGLIGGTNKR APGTPARFSGSSLGG SAALTLSGVQPEDE AEYYCALWYSNLW VFGGGTKLTVL | 110 |
| CD3.318 | | CD3 | EVQLVESGGGIVQP GGSLRLSCAASGFT FSTYAMNWVRQAP GKGLEWVGRIRTK RNDYATYYADSVK GRFTISRDDSKNTLY LQMNSLKTEDTAVY YCVRHENFGNSYVS WFAHWGQGTLVTV SS | 126 | ELVVTQEPSLTVSPG GTVTLTCRSSNGAV TSSNYANWVQQKP GQAPRGLIGGTNKR APGTPARFSGSLLEG KAALTLSGVQPEDE AVYYCALWYPNLW VFGGGTKLTVL | 127 |

*underlined sequences, if present, are CDRs within the VL and VH

In some embodiments, the disclosure relates to antigen binding fragments (AF) having specific binding affinity for an effector cell antigen.

Various AF that bind effector cell antigens, particularly CD3 on T cells, have particular utility for pairing with an antigen binding fragment with binding affinity to EGFR antigens associated with a diseased cell or tissue in composition formats in order to recruit and effect effector cell-mediated cell killing of the diseased cell or tissue.

Binding specificity to the antigen of interest can be determined by complementarity determining regions, or CDRs, such as light chain CDRs or heavy chain CDRs. In many cases, binding specificity is determined by light chain CDRs and heavy chain CDRs. A given combination of heavy chain CDRs and light chain CDRs provides a given binding pocket that confers greater affinity and/or specificity towards an effector cell antigen as compared to other reference antigens. The resulting bispecific compositions which on the one hand bind to an effector cell antigen and on the other hand bind to an antigen on the diseased cell or tissue, having a first antigen binding fragment to EGFR linked by a short, flexible peptide linker to a second antigen binding fragment with binding specificity to an effector cell antigen are bispecific, with each antigen binding fragment having specific binding affinity to their respective ligands.

It will be understood that in such compositions, an AF directed against EGFR of a disease tissue is used in combination with an AF directed towards an effector cell marker in order to bring an effector cell in close proximity to the cell of a disease tissue in order to effect the cytolysis of the cell of the diseased tissue. Further, the first antigen fragment (AF1) and the second antigen fragment (AF2) are incorporated into the specifically designed polypeptides comprising cleavable release segments and ELNN segments in order to confer inactive characteristics on the compositions that becomes activated by release of the fused AF1 and AF2 upon the cleavage of the release segments when in proximity to the disease tissue having proteases capable of cleaving the release segments in one or more locations in the release segment sequence.

In some embodiments, the AF2 of the subject compositions has binding affinity for an effector cell antigen expressed on the surface of a T cell. In some embodiments, the AF2 of the subject compositions has binding affinity for CD3. In some embodiments, the AF2 of the subject compositions has binding affinity for a member of the CD3 complex, which includes in individual form or independently combined form all known CD3 subunits of the CD3 complex; for example, CD3 epsilon. CD3 delta, CD3 gamma, and CD3 zeta. In some embodiments, the AF2 has binding affinity for CD3 epsilon, CD3 delta, CD3 gamma, or CD3 zeta.

In some embodiments, the disclosure provides an antigen binding domain (e.g., antibody or an antigen-binding fragment thereof) that binds to cluster of differentiation 3 T cell receptor (CD3), comprising the following CDRs: a VL domain CDR1 with an amino acid sequence that has at least 85%, 90%, 91%, 92%, 93%, 94%, 95%, 96%, 97%, 98%, or 99% identity, or 100% identity, to RSSX$_n$GAVTX$_2$SNYAN (SEQ ID NO:8023), wherein X$_1$ corresponds to T or N, and X$_2$ corresponds to T or S; a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL domain CDR3 with an amino acid sequence that has at least 85%, 90%, 91%, 92%, 93%, 94%, 95%, 96%, 97%, 98%, or 99% identity, or 100% identity, to ALWYX$_4$NLWV (SEQ ID NO: 8024), wherein X$_4$ corresponds to S or P; a VH domain CDR1 with an amino acid sequence that has at least 85%, 90%, 91%, 92%, 93%, 94%, 95%, 96%, 97%, 98%, or 99% identity, or 100% identity, to GFTFX$_8$TYAMN (SEQ ID NO:8025), wherein X$_8$ corresponds to S or N; a VH domain CDR2 with an amino acid sequence that has at least 85%, 90%, 91%, 92%, 93%, 94%, 95%, 96%, 97%, 98%, or 99% identity, or 100% identity, to RIRX$_{10}$KX$_1$NX$_{12}$YATYYADSVKX$_{13}$ (SEQ ID NO:8026), wherein X$_{10}$ corresponds to T or S, X$_{11}$ corresponds to R or Y, X$_{12}$ corresponds to D or N, and X$_{13}$ corresponds to Gor D; a VH domain CDR3 with an amino acid sequence that has at least 85%, 90%, 91%, 92%, 93%, 94%, 95%, 96%, 97%, 98%, or 99% identity, or 100% identity, to HX$_{14}$NFGNSYVSWFAX$_{15}$ (SEQ ID NO:8027), wherein X$_{14}$ corresponds to E or G, and X$_{15}$ corresponds to H or Y.

In some embodiments, the disclosure provides an antigen binding domain (e.g., antibody or an antigen-binding fragment thereof) that binds to cluster of differentiation 3 T cell receptor (CD3), comprising the following CDRs: a VL region CDR1 with an amino acid sequence that has at least 85%, 90%, 91%, 92%, 93%, 94%, 95%, 96%, 97%, 98%, or 99% identity, or 100% identity, to RSSNGAVTSSNYAN (SEQ ID NO:1); a VL region CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL region CDR3 with an amino acid sequence that has at least 85%, 90%, 91%, 92%, 93%, 94%, 95%, 96%, 97%, 98%, or 99% identity, or 100% identity, to ALWYPNLWV (SEQ ID NO: 6); a VH region CDR1 with an amino acid sequence that has at least 85%, 90%, 91%, 92%, 93%, 94%, 95%, 96%, 97%, 98%, or 99% identity, or 100% identity, to GFTFSTYAMN (SEQ ID NO: 12); a VH region CDR2 with an amino acid sequence that has at least 85%, 90%, 91%, 92%, 93%, 94%, 95%, 96%, 97%, 98%, or 99% identity, or 100% identity, to RIRTKRN-DYATYYADSVKG (SEQ ID NO:14); and a VH region CDR3 with an amino acid sequence that has at least 85%, 90%, 91%, 92%, 93%, 94%, 95%, 96%, 97%, 98%, or 99% identity, or 100% identity, to HENFGNSYVSWFAH (SEQ ID NO:10).

In some embodiments, the antigen binding domain comprises the following FRs: a VL region FR1 with an amino acid sequence that has at least 85%, 90%, 91%, 92%, 93%, 94%, 95%, 96%, 97%, 98%, or 99% identity, or 100% identity, to ELVVTQEPSLTVSPGGTVTLTC (SEQ ID NO:51); a VL region FR2 with an amino acid sequence that has at least 85%, 90%, 91%, 92%, 93%, 94%, 95%, 96%, 97%, 98%, or 99% identity, or 100% identity, to WVQQKPGQAPRGLIG (SEQ ID NO:52); a VL region FR3 with an amino acid sequence that has at least 85%, 90%, 91%, 92%, 93%, 94%, 95%, 96%, 97%, 98%, or 99% identity, or 100% identity, to GTPARFSGSLLEG-KAALTLSGVQPEDEAVYYC (SEQ ID NO: 403); a VL region FR4 with an amino acid sequence that has at least 85%, 90%, 91%, 92%, 93%, 94%, 95%, 96%, 97%, 98%, or 99% identity, or 100% identity, to FGGGTKLTVL (SEQ ID NO:59); a VH region FR1 with an amino acid sequence that has at least 85%, 90%, 91%, 92%, 93%, 94%, 95%, 96%, 97%, 98%, or 99% identity, or 100% identity, to EVOLVES-GGGIVQPGGSLRLSCAAS (SEQ ID NO: 400); a VH region FR2 with an amino acid sequence that has at least 85%, 90%, 91%, 92%, 93%, 94%, 95%, 96%, 97%, 98%, or 99% identity, or 100% identity, to WVRQAPGKGLEWVG (SEQ ID NO: 401); a VH region FR3 with an amino acid sequence that has at least 85%, 90%, 91%, 92%, 93%, 94%, 95%, 96%, 97%, 98%, or 99% identity, or 100% identity, to RFTISRDDSKNTLYLQMNSLKTEDTAVYYCVR (SEQ ID NO:404); and a VH region FR4 with an amino acid sequence that has at least 85%, 90%, 91%, 92%, 93%, 94%, 95%, 96%, 97%, 98%, or 99% identity, or 100% identity, to WGQGTLVTVSS (SEQ ID NO:67).

In some embodiments, the disclosure provides an antigen binding domain (e.g., antibody or an antigen-binding fragment thereof) that binds to CD3, comprising: a VL region comprising three VL CDRs, wherein the three VL CDRs comprise the CDR1, CDR2, and CDR3 of a VL region comprising the following amino acid sequence: ELVVTQEPSLTVSPGGTVTLTCRSSN-GAVTSSNYANWVQQKPGQAPRGLIGGTNKRAPGT-PARF SGSLLEGKAALTLSGVQPEDEAVYY-CALWYPNLWVFGGGTKLTVL (SEQ ID NO: 127); and a VH region comprising three VH CDRs, wherein the three VH CDRs comprise the CDR1, CDR2, and CDR3 of a VH region comprising the following amino acid sequence:

```
                              (SEQ ID NO: 126)
EVQLVESGGGIVQPGGSLRLSCAASGFTFSTYAMNWVRQAPGKGLEWVG

RIRTKRNDYATYYADSVKGRFTISRDDSKNTLYLQMNSLKTEDTAVYYC

VRHENFGNSYVSWFAHWGQGTLVTVSS.
```

In some embodiments, the disclosure provides an antigen binding domain (e.g., antibody or an antigen-binding fragment thereof) that binds to cluster of differentiation 3 T cell receptor (CD3), comprising the following CDRs: a VL region CDR1 with an amino acid sequence that has at least 85%, 90%, 91%, 92%, 93%, 94%, 95%, 96%, 97%, 98%, or 99% identity, or 100% identity, to RSSNGAVTSSNYAN (SEQ ID NO:1); a VL region CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4); a VL region CDR3 with an amino acid sequence that has at least 85%, 90%, 91%, 92%, 93%, 94%, 95%, 96%, 97%, 98%, or 99% identity, or 100% identity, to ALWYPNLWV (SEQ ID NO: 6); a VH region CDR1 with an amino acid sequence that has at least 85%, 90%, 91%, 92%, 93%, 94%, 95%, 96%, 97%, 98%, or 99% identity, or 100% identity, to GFTFSTYAMN (SEQ ID NO:12); a VH region CDR2 with an amino acid sequence that has at least 85%, 90%, 91%, 92%, 93%, 94%, 95%, 96%, 97%, 98%, or 99% identity, or 100% identity, to RIRTKRNNYATYYADSVKG (SEQ ID NO:13); and a VH region CDR3 with an amino acid sequence that has at least 85%, 90%, 91%, 92%, 93%, 94%, 95%, 96%, 97%, 98%, or 99% identity, or 100% identity, to HENFGNSYVSWFAH (SEQ ID NO: 10).

In some embodiments, the antigen binding domain comprises the following FRs: a VL region FR1 with an amino acid sequence that has at least 85%, 90%, 91%, 92%, 93%, 94%, 95%, 96%, 97%, 98%, or 99% identity, or 100% identity, to ELVVTQEPSLTVSPGGTVTLTC (SEQ ID NO:51); a VL region FR2 with an amino acid sequence that has at least 85%, 90%, 91%, 92%, 93%, 94%, 95%, 96%, 97%, 98%, or 99% identity, or 100% identity, to WVQQKPGQAPRGLIG (SEQ ID NO:52); a VL region FR3 with an amino acid sequence that has at least 85%, 90%, 91%, 92%, 93%, 94%, 95%, 96%, 97%, 98%, or 99% identity, or 100% identity, to GTPARFSGSLLGG-KAALTLSGVQPEDEAVYYC (SEQ ID NO: 53); a VL region FR4 with an amino acid sequence that has at least 85%, 90%, 91%, 92%, 93%, 94%, 95%, 96%, 97%, 98%, or 99% identity, or 100% identity, to FGGGTKLTVL (SEQ ID NO:59); a VH region FR1 with an amino acid sequence that has at least 85%, 90%, 91%, 92%, 93%, 94%, 95%, 96%, 97%, 98%, or 99% identity, or 100% identity, to EVOLVES-GGGIVQPGGSLRLSCAAS (SEQ ID NO: 400); a VH region FR2 with an amino acid sequence that has at least 85%, 90%, 91%, 92%, 93%, 94%, 95%, 96%, 97%, 98%, or 99% identity, or 100% identity, to WVRQAPGKGLEWVG (SEQ ID NO: 401); a VH region FR3 with an amino acid sequence that has at least 85%, 90%, 91%, 92%, 93%, 94%, 95%, 96%, 97%, 98%, or 99% identity, or 100% identity, to RFTISRDDSKNTVYLQMNSLKTEDTAVYYCVR (SEQ ID NO:402); and a VH region FR4 with an amino acid sequence that has at least 85%, 90%, 91%, 92%, 93%, 94%, 95%, 96%, 97%, 98%, or 99% identity, or 100% identity, to WGQGTLVTVSS (SEQ ID NO:67).

In some embodiments, the disclosure provides an antigen binding domain (e.g., antibody or an antigen-binding fragment thereof) that binds to CD3, comprising: a VL region comprising three the VL CDRs, wherein the three VL CDRs comprise the CDR1, CDR2, and CDR3 of a VL region comprising the following amino acid sequence:

```
                                (SEQ ID NO: 8204)
ELVVTQEPSLTVSPGGTVTLTCRSSX₁GAVTX₂SNYANWVQQKPGQAPRG

LIGGTNKRAPGTPARFSGSLLGGKAALTLSGVQPEDEAX₃YYCALWYX₄N

LWVFGGGTKLTVL,
``` wherein X₁ corresponds to T or N, X₂ corresponds to T or S, X₃ corresponds to E or V, and X₄ corresponds to S or P; and a VH region comprising three VH CDRs, wherein the three VH CDRs comprise the CDR1, CDR2, and CDR3 of a VH region comprising the following amino acid sequence: EVQLXₙESGGGX₆VQPGGSLX-LSCAASGFTFX₈TYAMNWVRQAPGKGLEWVX, RIRXJOKX₁NNY ATYYADSVKX₁₂RFTISRDDSKNTX₁₃YLQMNX₁₄LKT EDTAVYYCVRHX₁SNFGNSYVSWFAX₁₆W GQGTLVTVSS (SEQ ID NO:8205), wherein X₅ corresponds to V or L, X₆ corresponds to I or L, X₇ corresponds to R or K, X₈ corresponds to S or N, X₉ corresponds to G or A, X₁₀ corresponds to T or S, X₁₁ corresponds to R or Y, X₁₂ corresponds to G or D, X₁₃ corresponds to V or A, X₁₄ corresponds to S or N, X₁₅ corresponds to E or G, and X₁₆ corresponds to H or Y.

In some embodiments, the disclosure provides an antigen binding domain (e.g., antibody or an antigen-binding fragment thereof) that binds to CD3, comprising: a VL region comprising three VL CDRs, wherein the three VL CDRs comprise the CDR1, CDR2, and CDR3 of a VL region comprising the following amino acid sequence: ELVVTQEPSLTVSPGGTVTLTCRSSN-GAVTSSNYANWVQQKPGQAPRGLIGGTNKRAPGT-PARF SGSLLGGKAALTLSGVQPEDEAVYY-CALWYPNLWVFGGGTKLTVL (SEQ ID NO: 361); and a VH region comprising three VH CDRs, wherein the three VH CDRs comprise the CDR1, CDR2, and CDR3 of a VH region comprising the following amino acid sequence:

```
                                (SEQ ID NO: 311)
EVQLVESGGGIVQPGGSLRLSCAASGFTFSTYAMNWVRQAPGKGLEWVG

RIRTKRNNYATYYADSVKGRFTISRDDSKNTVYLQMNSLKTEDTAVYYC

VRHENFGNSYVSWFAHWGQGTLVTVSS.
```

In some embodiments, the disclosure provides an antigen binding domain (e.g., antibody or an antigen-binding fragment thereof) that binds to CD3, comprising a VL region amino acid sequence SEQ ID NO/VH region amino acid sequence SEQ ID NO pair selected from the group consisting of: 896/897; 902/903; 700/701; 702/703; 716/717; 718/719; 728/729; 736/737; 738/739; 740/741; 742/743; 744/745; 746/747; 748/749; 750/751; 752/753; 754/755; 756/757; 758/759; 760/761; 762/763; 764/765; 766/767; 774/775; 776/777; 790/791; 792/793; 798/799; 800/801; 806/807; 808/809; 814/815; 816/817; 822/823; 824/825; or 826/867.

In some embodiments, the present disclosure provides an antigen binding fragment (e.g., AF1 or AF2) that binds to the CD3 protein complex that has enhanced stability compared to CD3 binding antibodies or antigen binding fragments known in the art. In some embodiments, a CD3 antigen binding fragment of the disclosure is designed to confer a higher degree of stability on the chimeric bispecific antigen binding fragment compositions into which they are integrated, leading to improved expression and recovery of the fusion protein, increased shelf-life and enhanced stability when administered to a subject. In some embodiments, an anti-CD3 AF of the present disclosure has a higher degree of thermal stability compared to certain CD3-binding antibodies and antigen binding fragments known in the art. In some embodiments, an anti-CD3 AF of the present disclosure has a higher degree of thermal stability compared to SP34 or an antigen binding fragment thereof. In some embodiments, an anti-CD3 AF of the present disclosure has a higher degree of thermal stability compared to CD3.9 and/or CD3.23 as disclosed in PCT International Patent Application Publication No. WO2021263058, the entire content of which is hereby incorporated herein by reference. In some embodiments, the anti-CD3 AF of the present disclosure is less immunogenic in a human compared to certain CD3-binding antibodies and antigen binding fragments known in the art. In some embodiments, an anti-CD3 AF of the present disclosure is less immunogenic than SP34 or an antigen binding fragment thereof. In some embodiments, an anti-CD3 AF of the present disclosure is less immunogenic than CD3.9 and/or CD3.23 as disclosed in PCT International Patent Application Publication No. WO2021263058, the entire content of which is hereby incorporated herein by reference. In some embodiments, the degree to which an AF is immunogenic is determined by an immunogenicity prediction method such as TEPITOPEpan (described in Zhang et al. PLoS One. 2012; 7 (2): 30483. doi: 10.1371/journal-.ponc.0030483, PMID: 22383964, the entire content of which is incorporated herein by reference) or NetMHCpan-4.1 and NetMHCIIpan-4.0 (each described in Reynisson et al., Nucleic Acids Res 2020; 48 (W1): W449-W454. doi: 10.1093/nar/gkaa379., PMID: 32406916, the entire content of which is hereby incorporated herein by reference). In some embodiments, the anti-CD3 AF utilized as components of the chimeric bispecific antigen binding fragment compositions into which they are integrated exhibit favorable pharmaceutical properties, including high thermostability and low aggregation propensity, resulting in improved expression and recovery during manufacturing and storage, as well promoting long scrum half-life. Biophysical properties such as thermostability are often limited by the antibody variable domains, which differ greatly in their intrinsic properties. High thermal stability is often associated with high expression levels and other desired properties, including being less susceptible to aggregation (Buchanan A, et al. Engineering a therapeutic IgG molecule to address cysteinylation, aggregation and enhance thermal stability and expression. MAbs 2013; 5:255). In some embodiments, thermal stability is determined by measuring the "melting temperature" ($T_m$), which is defined as the temperature at which half of the molecules are denatured. The melting temperature of each heterodimer is indicative of its thermal stability. In vitro assays to determine Tm are known in the art, including methods described in the Examples, below. The melting point of the heterodimer may be measured using techniques such as differential scanning calorimetry (Chen et al (2003) Pharm Res 20:1952-60; Ghirlando et al (1999) Immunol Lett 68:47-52). Alternatively, the thermal stability of the heterodimer may be measured using circular dichroism (Murray et al. (2002) J. Chromatogr Sci 40:343-9), or as described in the Examples, below.

In some embodiments of the polypeptides of this disclosure, the antigen binding fragment (e.g., AF1 or AF2) can exhibit a higher thermal stability than an anti-CD3 binding fragment consisting of a sequence of SEQ ID NO: 206 (see Table 5c), as evidenced in an in vitro assay by a higher melting temperature ($T_m$) of the first antigen binding fragment relative to that of the anti-CD3 binding fragment; or upon incorporating the first antigen binding fragment into a test bispecific antigen binding domain, a higher Tm of the test bispecific antigen binding domain relative to that of a control bispecific antigen binding domain, wherein the test bispecific antigen binding domain comprises the first antigen binding fragment and a reference antigen binding fragment that binds to an antigen other than CD3; and wherein the control bispecific antigen binding domain consists of the anti-CD3 binding fragment consisting of the sequence of SEQ ID NO:206 (see Table 5e) and the reference antigen binding fragment. In some embodiments, the melting temperature ($T_m$) of the first antigen binding fragment can be at least 2° C. greater, or at least 3° C. greater, or at least 4° C. greater, or at least 5° C. greater than the Tm of the anti-CD3 binding fragment consisting of the sequence of SEQ ID NO: 206 (see Table 5c).

In some embodiments, the polypeptides of any of the subject composition embodiments described herein comprise an antigen binding fragment (AF) that specifically bind human CD3. The antigen binding fragment (AF) can specifically bind human CD3. In some embodiments, the antigen binding fragment (AF) can bind a CD3 complex subunit identified herein as CD3 epsilon, CD3 delta, CD3 gamma, or CD3 zeta unit of CD3. The antigen binding fragment (AF) can bind a CD3 epsilon fragment of CD3. In some embodiments, the antigen binding fragment (AF) can specifically bind human CD3 with a binding affinity ($k_D$)) constant between about 10 nM and about 400 nM, or between about 50 nM and about 350 nM, or between about 100 nM and 300 nM, as determined in an in vitro antigen-binding assay comprising a human CD3 antigen. In some embodiments, the polypeptides of any of the subject composition embodiments described herein comprise an antigen binding fragment (AF) that specifically binds human CD3 with a binding affinity ($K_D$) weaker than about 10 nM, or about 50 nM, or about 100 nM, or about 150 nM, or about 200 nM, or about 250 nM, or about 300 nM, or about 350 nM, or weaker than about 400 nM as determined in an in vitro antigen-binding assay. For clarity, an antigen binding fragment (AF) with a $k_D$ of 400 binds its ligand more weakly than one with a $k_D$ of 10 nM. In some embodiments, the polypeptides of any of the subject composition embodiments described herein comprise an antigen binding fragment (AF) that specifically binds human CD3 with at least 2-fold, 3-fold, 4-fold, 5-fold, 6-fold, 7-fold, 8-fold, 9-fold, or at least 10-fold weaker binding affinity than an antigen binding fragment consisting of an amino acid sequence of Table 5a-e, as determined by the respective binding affinities ($k_D$) in an in vitro antigen-binding assay.

In some embodiments, the present disclosure provides bispecific polypeptides comprising an antigen binding fragment (AF) that exhibits a binding affinity to CD3 (anti-CD3 AF) that is at least 2-fold, 3-fold, 4-fold, 5-fold, 6-fold, 7-fold, 8-fold, 9-fold, 10-fold, 20-fold, 50-fold, 100-fold, or at least 1000-fold at weaker relative to that of an anti-EGFR AF embodiments described herein that are incorporated into the subject polypeptides, as determined by the respective binding affinities ($k_D$) in an in vitro antigen-binding assay.

The binding affinity of the subject compositions for the target ligands can be assayed, e.g., using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. The binding affinity constant can then be determined using standard methods, such as Scatchard analysis, as described by van Zoelen, et al., Trends Pharmacol Sciences (1998) 19) 12): 487, or other methods known in the art.

In some embodiments, the present disclosure provides an antigen binding fragment (AF) that binds to CD3 (anti-CD3 AF) and is incorporated into a chimeric, bispecific polypeptide composition that is designed to have an isoelectric point (pI) that confers enhanced stability on the composition compared to corresponding compositions comprising CD3 binding antibodies or antigen binding fragments known in the art. In some embodiments, the polypeptides of any of the subject composition embodiments described herein comprise AF that bind to CD3 (anti-CD3 AF) wherein the anti-CD3 AF exhibits a pI that is between 6.0 and 6.6, inclusive. In some embodiments, the polypeptides of any of the subject composition embodiments described herein comprise AF that bind to CD3 (anti-CD3 AF) wherein the anti-CD3 AF exhibits a pI that is at least 0.1, 0.2, 0.3, 0.4, 0.5, 0.6, 0.7, 0.8, 0.9, or 1.0 pH unit lower than the pI of a reference antigen binding fragment (e.g., consisting of a sequence shown in SEQ ID NO: 206 (see Table 5e)). In some embodiments, the polypeptides of any of the subject composition embodiments described herein comprise an AF that binds to CD3 (anti-CD3 AF) fused to another AF that binds to a EGFR antigen (anti-EGFR AF) wherein the anti-CD3 AF exhibits a pI that is within at least 0.1, 0.2, 0.3, 0.4, 0.5, 0.6, 0.7, 0.8, 0.9, 1.0, 1.1, 1.2, 1.3, 1.4, or 1.5 pH units of the pI of the AF that binds EGFR antigen or an epitope thereof. In some embodiments, the polypeptides of any of the subject composition embodiments described herein comprise an AF that binds to CD3 (anti-CD3 AF) fused to an AF that binds to a EGFR antigen (anti-EGFR AF) wherein the AF exhibits a pI that is within at least about 0.1 to about 1.5, or at least about 0.3 to about 1.2, or at least about 0.5 to about 1.0, or at least about 0.7 to about 0.9 pH units of the pI of the anti-CD3 AF. It is specifically intended that by such design wherein the pI of the two antigen binding fragments are within such ranges, the resulting fused antigen binding fragments will confer a higher degree of stability on the chimeric bispecific antigen binding fragment compositions into which they are integrated, leading to improved expression and enhanced recovery of the fusion protein in soluble, non-aggregated form, increased shelf-life of the formulated chimeric bispecific polypeptide compositions, and enhanced stability when the composition is administered to a subject. In some embodiments, having the two AFs (the anti-CD3 AF and the anti-EGFR AF) within a relatively narrow pI range of may allow for the selection of a buffer or other solution in which both the AFs (anti-CD3 AF and anti-EGFR AF) are stable, thereby promoting overall stability of the composition. In some embodiments, the antigen binding fragment (AF) can exhibit an isoelectric point (pI) that is less than or equal to 6.6. In some embodiments, the antigen binding fragment (AF) can exhibit an isoelectric point (pI) that is between 6.0 and 6.6, inclusive. In some embodiments, the antigen binding fragment (AF) can exhibit an isoelectric point (pI) that is at least 0.1, 0.2, 0.3, 0.4, 0.5, 0.6, 0.7, 0.8, 0.9, or 1.0 pH units lower than the pI of a reference antigen binding fragment consisting of a sequence shown in SEQ ID NO: 206 (see Table 5c). In some embodiments, the antigen binding fragment (AF) can specifically bind human CD3 with a binding affinity ($k_D$) constant between about between about 10 nM and about 400 nM (such as determined in an in vitro antigen-binding assay comprising a human CD3 antigen). In some embodiments, the antigen binding fragment (AF) can specifically bind human CD3 with a binding affinity ($k_D$)) of less than about 10 nM, or less than about 50 nM, or less than about 100 nM, or less than about 150 nM, or less than about 200 nM, or less than about 250 nM, or less than about 300 nM, or less than about 350 nM, or less than about 400 nM (such as determined in an in vitro antigen-binding assay). In some embodiments, the antigen binding fragment (AF) can exhibit a binding affinity to CD3 that is at least 2-fold, 3-fold, 4-fold, 5-fold, 6-fold, 7-fold, 8-fold, 9-fold, or at least 10-fold weaker relative to that of an antigen binding fragment consisting of an amino acid sequence of SEQ ID NO: 206 (see Table 5c) (such as determined by the respective binding affinities ($K_D$) in an in vitro antigen-binding assay).

In some embodiments, the VL and VH of the antigen binding fragments are fused by relatively long linkers, consisting of 25, 26, 27, 28, 29, 30, 31, 32, 33, 34, or 35 hydrophilic amino acids that, when joined together, have a flexible characteristic. In some embodiments, the VL and VH of any of the scFv embodiments described herein are linked by a relatively long linker having the sequence SESATPESGPGTSPGATPESGPGTSESATP (SEQ ID NO: 81). In some embodiments, the VL and VH of any of the scFv embodiments described herein are linked by relatively long linkers of hydrophilic amino acids having the sequences GSGEGSEGEGGGEGSEGEGSGEGGEGEGSG (SEQ ID NO: 82), TGSGEGSEGEGGGEGSEGEGSGEGGEGEGSGT (SEQ ID NO: 83), GATPPETGAETESPGETTGGSAESEPPGEG (SEQ ID NO: 84), or GSAAPTAGTTPSASPAPPTGGS-SAAGSPST (SEQ ID NO: 85). In some embodiments, the AF1 and AF2 are linked together by a short linker of hydrophilic amino acids having 3, 4, 5, 6, or 7 amino acids. In some embodiments, the short linker sequences are identified herein as the sequences SGGGGS (SEQ ID NO: 86), GGGGS (SEQ ID NO: 87), GGSGGS (SEQ ID NO: 88), GGS, or GSP. In some embodiments, the disclosure provides compositions comprising a single chain diabody in which after folding, the first domain (VL or VH) is paired with the last domain (VH or VL) to form one scFv and the two domains in the middle are paired to form the other scFv in which the first and second domains, as well as the third and last domains, are fused together by one of the foregoing short linkers and the second and the third variable domains are fused by one of the foregoing relatively long linkers. In some embodiments, the selection of the short linker and relatively long linker is to prevent the incorrect pairing of adjacent variable domains, thereby facilitating the formation of a single chain configuration comprising the VL and VH of the first antigen binding fragment and the second antigen binding fragment.

TABLE 5b

Exemplary CD3 CDR Sequences

| Antibody Domain | CDR REGION | Amino Acid Sequence | SEQ ID NO: |
|---|---|---|---|
| 3.23, 3.30, 3.31, 3.32, 3.228, 3.318 | CDR-L1 | RSSNGAVTSSNYAN | 1 |
| 3.24 | CDR-L1 | RSSNGEVTTSNYAN | 2 |
| 3.33, 3.9 | CDR-L1 | RSSTGAVTTSNYAN | 3 |
| 3.23, 3.30, 3.31, 3.32, 3.9, 3.33, 3.228, 3.318 | CDR-L2 | GTNKRAP | 4 |
| 3.24 | CDR-L2 | GTIKRAP | 5 |
| 3.23, 3.24, 3.30, 3.31, 3.32, 3.228, 3.318 | CDR-L3 | ALWYPNLWV | 6 |
| 3.33, 3.9 | CDR-L3 | ALWYSNLWV | 7 |
| 3.23, 3.24, 3.30, 3.31, 3.32, 3.9, 3.33 | CDR-H1 | GFTFNTYAMN | 8 |

TABLE 5b-continued

| Antibody Domain | CDR REGION | Amino Acid Sequence | SEQ ID NO: |
|---|---|---|---|
| 3.228, 3.318 | CDR-H1 | GFTFSTYAMN | 12 |
| 3.23, 3.24, 3.30, 3.31, 3.32, 3.9, 3.33 | CDR-H2 | RIRSKYNNYATYYADSVKD | 9 |
| 3.228 | CDR-H2 | RIRTKRNNYATYYADSVKG | 13 |
| 3.318 | CDR-H2 | RIRTKRNDYATYYADSVKG | 14 |
| 3.23, 3.24, 3.30, 3.31, 3.32, 3.228, 3.318 | CDR-H3 | HENFGNSYVSWFAH | 10 |
| 3.9, 3.33 | CDR-H3 | HGNFGNSYVSWFAY | 11 |

TABLE 5c

Exemplary CD3 FR Sequences

| Antibody Domain | FR REGION | Amino Acid Sequence | SEQ ID NO: |
|---|---|---|---|
| 3.23, 3.24, 3.30, 3.31, 3.32, 3.9, 3.33, 3.228, 3.318 | FR-L1 | ELVVTQEPSLTVSPGGTVTLTC | 51 |
| 3.23, 3.24, 3.30, 3.31, 3.32, 3.9, 3.33, 3.228, 3.318 | FR-L2 | WVQQKPGQAPRGLIG | 52 |
| 3.23, 3.24, 3.228 | FR-L3 | GTPARFSGSLLGGKAALTLSGVQPEDEAVYYC | 53 |
| 3.30 | FR-L3 | GTPARFSGSSLGGKAALTLSGVQPEDEAVYYC | 54 |
| 3.31 | FR-L3 | GTPARFSGSLLGGSAALTLSGVQPEDEAVYYC | 55 |
| 3.32 | FR-L3 | GTPARFSGSSLGGSAALTLSGVQPEDEAVYYC | 56 |
| 3.9 | FR-L3 | GTPARFSGSLLGGKAALTLSGVQPEDEAEYYC | 57 |
| 3.33 | FR-L3 | GTPARFSGSSLGGSAALTLSGVQPEDEAEYYC | 58 |
| 3.318 | FR-L3 | GTPARFSGSLLEGKAALTLSGVQPEDEAVYYC | 403 |
| 3.23, 3.24, 3.30, 3.31, 3.32, 3.9, 3.33, 3.228, 3.318 | FR-L4 | FGGGTKLTVL | 59 |
| 3.228, 3.318 | FR-H1 | EVQLVESGGGIVQPGGSLRLSCAAS | 400 |
| 3.23, 3.24 | FR-H1 | EVQLLESGGGIVQPGGSLKLSCAAS | 60 |
| 3.30, 3.31, 3.32 | FR-H1 | EVQLQESGGGIVQPGGSLKLSCAAS | 61 |
| 3.33 | FR-H1 | EVQLQESGGGLVQPGGSLKLSCAAS | 62 |
| 3.9 | FR-H1 | EVQLLESGGGLVQPGGSLKLSCAAS | 63 |
| 3.23, 3.24, 3.30, 3.31, 3.32, 3.9, 3.33 | FR-H2 | WVRQAPGKGLEWVA | 64 |
| 3.228, 3.318 | FR-H2 | WVRQAPGKGLEWVG | 401 |
| 3.23, 3.24, 3.30, 3.31, 3.32 | FR-H3 | RFTISRDDSKNTVYLQMNNLKTEDTAVYYCVR | 65 |
| 3.9, 3.33 | FR-H3 | RFTISRDDSKNTAYLQMNNLKTEDTAVYYCVR | 66 |
| 3.228 | FR-H3 | RFTISRDDSKNTVYLQMNSLKTEDTAVYYCVR | 402 |
| 3.318 | FR-H3 | RFTISRDDSKNTLYLQMNSLKTEDTAVYYCVR | 404 |

TABLE 5c-continued

| | | Exemplary CD3 FR Sequences | |
|---|---|---|---|
| Antibody Domain | FR REGION | Amino Acid Sequence | SEQ ID NO: |
| 3.23, 3.24, 3.30, 3.31, 3.32, 3.9, 3.33, 3.228, 3.318 | FR-H4 | WGQGTLVTVSS | 67 |

TABLE 5d

| | | Exemplary CD3 VL & VH Sequences | |
|---|---|---|---|
| Antibody Domain | REGION | Amino Acid Sequence | SEQ ID NO: |
| 3.23 | VL | ELVVTQEPSLTVSPGGTVTLTCRSSNGAVTSSNYANWVQQKPGQ APRGLIGGTNKRAPGTPARFSGSLLGGKAALTLSGVQPEDEAVY YCALWYPNLWVFGGGTKLTVL | 101 |
| 3.23, 3.24 | VH | EVQLLESGGGIVQPGGSLKLSCAASGFTFNTYAMNWVRQAPGKG LEWVARIRSKYNNYATYYADSVKDRFTISRDDSKNTVYLQMNN LKTEDTAVYYCVRHENFGNSYVSWFAHWGQGTLVTVSS | 102 |
| 3.24 | VL | ELVVTQEPSLTVSPGGTVTLTCRSSNGEVTTSNYANWVQQKPGQ APRGLIGGTIKRAPGTPARFSGSLLGGKAALTLSGVQPEDEAVYY CALWYPNLWVFGGGTKLTVL | 103 |
| 3.30 | VL | ELVVTQEPSLTVSPGGTVTLTCRSSNGAVTSSNYANWVQQKPGQ APRGLIGGTNKRAPGTPARFSGSLLGGKAALTLSGVQPEDEAVYY CALWYPNLWVFGGGTKLTVL | 104 |
| 3.30, 3.31, 3.32 | VH | EVQLQESGGGIVQPGGSLKLSCAASGFTFNTYAMNWVRQAPGK GLEWVARIRSKYNNYATYYADSVKDRFTISRDDSKNTVYLQMN NLKTEDTAVYYCVRHENFGNSYVSWFAHWGQGTLVTVSS | 105 |
| 3.31 | VL | ELVVTQEPSLTVSPGGTVTLTCRSSNGAVTSSNYANWVQQKPGQ APRGLIGGTNKRAPGTPARFSGSLLGGSAALTLSGVQPEDEAVYY CALWYPNLWVFGGGTKLTVL | 106 |
| 3.32 | VL | ELVVTQEPSLTVSPGGTVTLTCRSSNGAVTSSNYANWVQQKPGQ APRGLIGGTNKRAPGTPARFSGSLLGGSAALTLSGVQPEDEAVYY CALWYPNLWVFGGGTKLTVL | 107 |
| 3.9 | VL | ELVVTQEPSLTVSPGGTVTLTCRSSTGAVTTSNYANWVQQKPGQ APRGLIGGTNKRAPGTPARFSGSLLGGKAALTLSGVQPEDEAEYY CALWYSNLWVFGGGTKLTVL | 108 |
| 3.9 | VH | EVQLLESGGGLVQPGGSLKLSCAASGFTFNTYAMNWVRQAPGK GLEWVARIRSKYNNYATYYADSVKDRFTISRDDSKNTAYLQMN NLKTEDTAVYYCVRHGNFGNSYVSWFAYWGQGTLVTVSS | 109 |
| 3.33 | VL | ELVVTQEPSLTVSPGGTVTLTCRSSTGAVTTSNYANWVQQKPGQ APRGLIGGTNKRAPGTPARFSGSLLGGSAALTLSGVQPEDEAEYY CALWYSNLWVFGGGTKLTVL | 110 |
| 3.33 | VH | EVQLQESGGGLVQPGGSLKLSCAASGFTFNTYAMNWVRQAPGK GLEWVARIRSKYNNYATYYADSVKDRFTISRDDSKNTAYLQMN NLKTEDTAVYYCVRHGNFGNSYVSWFAYWGQGTLVTVSS | 111 |
| 3.228 | VL | ELVVTQEPSLTVSPGGTVTLTCRSSNGAVTSSNYANWVQQKPGQ APRGLIGGTNKRAPGTPARFSGSLLGGKAALTLSGVQPEDEAVY YCALWYPNLWVFGGGTKLTVL | 361 |
| 3.228 | VH | EVQLVESGGGIVQPGGSLRLSCAASGFTFSTYAMNWVRQAPGKG LEWVGRIRTKRNNYATYYADSVKGRFTISRDDSKNTVYLQMNSL KTEDTAVYYCVRHENFGNSYVSWFAHWGQGTLVTVSS | 311 |
| 3.318 | VL | ELVVTQEPSLTVSPGGTVTLTCRSSNGAVTSSNYANWVQQKPGQ APRGLIGGTNKRAPGTPARFSGSLLEGKAALTLSGVQPEDEAVYY CALWYPNLWVFGGGTKLTVL | 127 |
| 3.318 | VH | EVQLVESGGGIVQPGGSLRLSCAASGFTFSTYAMNWVRQAPGKG LEWVGRIRTKRNDYATYYADSVKGRFTISRDDSKNTLYLQMNSL KTEDTAVYYCVRHENFGNSYVSWFAHWGQGTLVTVSS | 126 |

TABLE 5e

<table>
<tr><td colspan="3">Exemplary CD3 scFv Sequences</td></tr>
<tr><td>Antibody<br>Domain</td><td>Amino Acid Sequence</td><td>SEQ ID<br>NO:</td></tr>
<tr><td>3.23</td><td>ELVVTQEPSLTVSPGGTVTLTCRSSNGAVTSSNYANWVQQKPGQAPRGLIGGTNK<br>RAPGTPARFSGSLLGGKAALTLSGVQPEDEAVYYCALWYPNLWVFGGGTKLTVL<br>GATPPETGAETESPGETTGGSAESEPPGEGEVQLLESGGGIVQPGGSLKLSCAASGF<br>TFNTYAMNWVRQAPGKGLEWVARIRSKYNNYATYYADSVKDRFTISRDDSKNTV<br>YLQMNNLKTEDTAVYYCVRHENFGNSYVSWFAHWGQGTLVTVSS</td><td>201</td></tr>
<tr><td>3.24</td><td>ELVVTQEPSLTVSPGGTVTLTCRSSNGEVTTSNYANWVQQKPGQAPRGLIGGTIKR<br>APGTPARFSGSLLGGKAALTLSGVQPEDEAVYYCALWYPNLWVFGGGTKLTVLG<br>ATPPETGAETESPGETTGGSAESEPPGEGEVQLLESGGGIVQPGGSLKLSCAASGFT<br>FNTYAMNWVRQAPGKGLEWVARIRSKYNNYATYYADSVKDRFTISRDDSKNTV<br>YLQMNNLKTEDTAVYYCVRHENFGNSYVSWFAHWGQGTLVTVSS</td><td>202</td></tr>
<tr><td>3.30</td><td>ELVVTQEPSLTVSPGGTVTLTCRSSNGAVTSSNYANWVQQKPGQAPRGLIGGTNK<br>RAPGTPARFSGSSLGGKAALTLSGVQPEDEAVYYCALWYPNLWVFGGGTKLTVL<br>GATPPETGAETESPGETTGGSAESEPPGEGEVQLQESGGGIVQPGGSLKLSCAASGF<br>TFNTYAMNWVRQAPGKGLEWVARIRSKYNNYATYYADSVKDRFTISRDDSKNTV<br>YLQMNNLKTEDTAVYYCVRHENFGNSYVSWFAHWGQGTLVTVSS</td><td>203</td></tr>
<tr><td>3.31</td><td>ELVVTQEPSLTVSPGGTVTLTCRSSNGAVTSSNYANWVQQKPGQAPRGLIGGTNK<br>RAPGTPARFSGSLLGGSAALTLSGVQPEDEAVYYCALWYPNLWVFGGGTKLTVL<br>GATPPETGAETESPGETTGGSAESEPPGEGEVQLQESGGGIVQPGGSLKLSCAASGF<br>TFNTYAMNWVRQAPGKGLEWVARIRSKYNNYATYYADSVKDRFTISRDDSKNTV<br>YLQMNNLKTEDTAVYYCVRHENFGNSYVSWFAHWGQGTLVTVSS</td><td>204</td></tr>
<tr><td>3.32</td><td>ELVVTQEPSLTVSPGGTVTLTCRSSNGAVTSSNYANWVQQKPGQAPRGLIGGTNK<br>RAPGTPARFSGSSLGGSAALTLSGVQPEDEAVYYCALWYPNLWVFGGGTKLTVL<br>GATPPETGAETESPGETTGGSAESEPPGEGEVQLQESGGGIVQPGGSLKLSCAASGF<br>TFNTYAMNWVRQAPGKGLEWVARIRSKYNNYATYYADSVKDRFTISRDDSKNTV<br>YLQMNNLKTEDTAVYYCVRHENFGNSYVSWFAHWGQGTLVTVSS</td><td>205</td></tr>
<tr><td>3.9</td><td>ELVVTQEPSLTVSPGGTVTLTCRSSTGAVTTSNYANWVQQKPGQAPRGLIGGTNK<br>RAPGTPARFSGSLLGGKAALTLSGVQPEDEAEYYCALWYSNLWVFGGGTKLTVL<br>GATPPETGAETESPGETTGGSAESEPPGEGEVQLLESGGGLVQPGGSLKLSCAASGF<br>TFNTYAMNWVRQAPGKGLEWVARIRSKYNNYATYYADSVKDRFTISRDDSKNTA<br>YLQMNNLKTEDTAVYYCVRHGNFGNSYVSWFAYWGQGTLVTVSS</td><td>206</td></tr>
<tr><td>3.33</td><td>ELVVTQEPSLTVSPGGTVTLTCRSSTGAVTTSNYANWVQQKPGQAPRGLIGGTNK<br>RAPGTPARFSGSSLGGSAALTLSGVQPEDEAEYYCALWYSNLWVFGGGTKLTVLG<br>ATPPETGAETESPGETTGGSAESEPPGEGEVQLQESGGGLVQPGGSLKLSCAASGFT<br>FNTYAMNWVRQAPGKGLEWVARIRSKYNNYATYYADSVKDRFTISRDDSKNTA<br>YLQMNNLKTEDTAVYYCVRHGNFGNSYVSWFAYWGQGTLVTVSS</td><td>207</td></tr>
<tr><td>4.11</td><td>QSVLTQPPSASGTPGQRVTISCSGSSSNIGSNYVYWYQQLPGTAPKLLIYRNNQRPS<br>GVPDRFSGSKSGTSASLAISGLRSEDEADYYCAAWDDSLSGLWVFGGGTKLTVLG<br>ATPPETGAETESPGETTGGSAESEPPGEGQVQLQQWGGGLVKPGGSLRLSCAASGF<br>TFSSYSMNWVRQAPGKGLEWVSRINSDGSSTNYADSVKGRFTISRDNAKNTLYLQ<br>MNSLRAEDTAVYYCARELRWGNWGQGTLVTVSS</td><td>208</td></tr>
<tr><td>4.12</td><td>QAGLTQPPSASGTPGQRVTLSCSGSYSNIGTYYVYWYQQLPGTAPKLLIYSNDQRL<br>SGVPDRFSGSKSGTSASLAISGLQSEDEAAYYCAAWDDSLNGWAFGGGTKLTVLG<br>ATPPETGAETESPGETTGGSAESEPPGEGQVQLQQWGGGLVKPGGSLRLSCAASGF<br>TFSSYSMNWVRQAPGKGLEWVSRINSDGSSTNYADSVKGRFTISRDNAKNTLYLQ<br>MNSLRAEDTAVYYCARELRWGNWGQGTLVTVSS</td><td>209</td></tr>
<tr><td>4.13</td><td>QPGLTQPPSASGTPGQRVTLSCSGRSSNIGSYYVYWYQHLPGMAPKLLIYRNSRRP<br>SGVPDRFSGSKSGTSASLVISGLQSDDEADYYCAAWDDSLKSWVFGGGTKLTVLG<br>ATPPETGAETESPGETTGGSAESEPPGEGQVQLQQWGGGLVKPGGSLRLSCAASGF<br>TFSSYSMNWVRQAPGKGLEWVSRINSDGSSTNYADSVKGRFTISRDNAKNTLYLQ<br>MNSLRAEDTAVYYCARELRWGNWGQGTLVTVSS</td><td>210</td></tr>
<tr><td>4.14</td><td>QSVLTQPPSASGTPGQRVTISCSGSSSNIGTNYVYWYQQFPGTAPKLLIYSNNQRPS<br>GVPDRFSGSKSGTSGSLAISGLQSEDEADYSCAAWDDSLNGWVFGGGTKLTVLGA<br>TPPETGAETESPGETTGGSAESEPPGEGQVQLVQWGGGLVKPGGSLRLSCAASGFT<br>FSSYSMNWVRQAPGKGLEWVSRINSDGSSTNYADSVKGRFTISRDNAKNTLYLQ<br>MNSLRAEDTAVYYCARELRWGNWGQGTLVTVSS</td><td>211</td></tr>
<tr><td>4.15</td><td>QPGLTQPPSASGTPGQRVTISCSGSSSNIGSNYVYWYQQLPGTAPKLLIYRNNQRPS<br>GVPDRLSGSKSGTSASLAISGLRSEDEADYYCAAWDDSLSGWVFGGGTKLTVLGA<br>TPPETGAETESPGETTGGSAESEPPGEGQVQLVQWGGGLVKPGGSLRLSCAASGFT<br>FSSYSMNWVRQAPGKGLEWVSRINSDGSSTNYADSVKGRFTISRDNAKNTLYLQ<br>MNSLRAEDTAVYYCARELRWGNWGQGTLVTVSS</td><td>212</td></tr>
<tr><td>4.16</td><td>QAVLTQPPSASGTPGQRVTISCSGSSSNIGSYYVYWYQQVPGAAPKLLMRLNNQR<br>PSGVPDRFSGAKSGTSASLVISGLRSEDEADYYCAAWDDSLSGQWVFGGGTKLTV<br>LGATPPETGAETESPGETTGGSAESEPPGEGQVQLQQWGGGLVKPGGSLRLSCAAS</td><td>213</td></tr>
</table>

TABLE 5e-continued

Exemplary CD3 scFv Sequences

| Antibody Domain | Amino Acid Sequence | SEQ ID NO: |
|---|---|---|
| | GFTFSSYSMNWVRQAPGKGLEWVSRINSDGSSTNYADSVKGRFTISRDNAKNTLY LQMNSLRAEDTAVYYCARELRWGNWGQGTLVTVSS | |
| 4.17 | QAGLTQPPSASGTPGQRVTISCSGSSSNIGSNYVYWYQQLPGTAPKLLIYRNNQRPS GVPDRFSGSKSGTSASLAISGLRSEDEADYYCATWDASLSGWVFGGGTKLTVLGA TPPETGAETESPGETTGGSAESEPPGEGEVQLVQWGGGLVKPGGSLRLSCAASGFT FSSYSMNWVRQAPGKGLEWVSRINSDGSSTNYADSVKGRFTISRDNAKNTLYLQ MNSLRAEDTAVYYCARELRWGNWGQGTLVTVSS | 214 |
| 3.228 | ELVVTQEPSLTVSPGGTVTLTCRSSNGAVTSSNYANWVQQKPGQAPRGLIGGTNK RAPGTPARFSGSLLGGKAALTLSGVQPEDEAVYYCALWYPNLWVFGGGTKLTVL SESATPESGPGTSPGATPESGPGTSESATPEVQLVESGGGIVQPGGSLRLSCAASGFT FSTYAMNWVRQAPGKGLEWVGRIRTKRNNYATYYADSVKGRFTISRDDSKNTVY LQMNSLKTEDTAVYYCVRHENFGNSYVSWFAHWGQGTLVTVSS | 215 |
| 3.318 | ELVVTQEPSLTVSPGGTVTLTCRSSNGAVTSSNYANWVQQKPGQAPRGLIGGTNK RAPGTPARFSGSLLEGKAALTLSGVQPEDEAVYYCALWYPNLWVFGGGTKLTVLS ESATPESGPGTSPGATPESGPGTSESATPEVQLVESGGGIVQPGGSLRLSCAASGFTF STYAMNWVRQAPGKGLEWVGRIRTKRNDYATYYADSVKGRFTISRDDSKNTLYL QMNSLKTEDTAVYYCVRHENFGNSYVSWFAHWGQGTLVTVSS | 128 |

Anti-EGFR Binding Domains

Also provided are anti-EGFR antibodies, fragments thereof, and fusion proteins comprising such antibodies and/or fragments.

In some embodiments, the present disclosure provides paTCE compositions comprising a first portion binding domain with binding affinity to the tumor-specific marker EGFR and a second binding domain that binds to an effector cell antigen, such as CD3 antigen.

In some embodiments, the first portion binding domain is an scFv domain, comprising a VH domain and a VL domain. Non-limiting examples of VH and VL domain sequences are provided in Table 5f. In some embodiments, the binding domain with binding affinity for the tumor-specific marker EGFR is an scFv domain comprising a VH and VL domain, listed in Table 5f. In some embodiments, the binding domain with binding affinity for EGFR is a scFv domain comprising three CDRs from a VH domain listed in Table 5f and three CDRs from a VL listed in Table 5f.

In some embodiments, the present disclosure provides a paTCE composition comprising a first portion binding domain with binding affinity to the tumor-specific marker EGFR comprising anti-EGFR VH and VL sequences set forth in Table 5f. In some embodiments, the binding has a $k_D$ value of about $10^{-10}$ to $10^{-7}$ M, as determined in an in vitro binding assay. In some embodiments, the binding has a $K_D$ value of about 1-10 nM, as determined in an in vitro binding assay. In some embodiments, the binding has a $K_D$ value of about 2 nM, as determined in an in vitro binding assay. It is specifically contemplated that the paTCE composition can comprise any one of the binding domains disclosed herein or sequence variants thereof so long as the variants exhibit binding specificity for the described antigen.

TABLE 5f

Anti-EGFR VH and VL Sequences

| Antibody Name | AC Number | VH Sequence | SEQ ID NO: | VL Sequence | SEQ ID NO: |
|---|---|---|---|---|---|
| EGFR.2 Donor antibody | AC2876 | QVQLQESGPGLVKPS ETLSLTCTVSGGSVSS GDYYWTWIRQSPGK GLEWIGHIYYSGNTN YNPSLKSRLTISIDTS KTQFSLKLSSVTAAD TAIYYCVRDRVTGAF DIWGQGTMVTVSS | 450 | DIQMTQSPSSLSA SVGDRVTITCQAS QDISNYLNWYQQ KPGKAPKLLIYD ASNLETGVPSRFS GSGSGTDFTFTISS LQPEDIATYFCQH FDHLPLAFGGGT KVEIK | 451 |
| EGFR.29 | AC2877 | QVQLVQSGAEVKKP GASVKVSCKASGGS VSSGDYYWTWVRQA PGQGLEWMGHIYYS GNTNYNPSLKSRVTS TRDTSISTAYMELSRL RSDDTVVYYCARDR VTGAFDIWGQGTLVT VSS | 452 | DIQMTQSPSSLSA SVGDRVTITCQAS QDISNYLNWYQQ KPGKAPKLLIYD ASNLETGVPSRFS GSGSGTDFTFTISS LQPEDIATYYCQ HFDHLPLAFGQG TKVEIK | 453 |
| EGFR.30 | AC2878 | QVQLVQSGAEVKKP GASVKVSCKASGGS VSSGDYYWTWVRQA | 454 | DIQMTQSPSSLSA SVGDRVTITCQAS QDISNYLNWYQQ | 455 |

TABLE 5f-continued

Anti-EGFR VH and VL Sequences

| Antibody Name | AC Number | VH Sequence | SEQ ID NO: | VL Sequence | SEQ ID NO: |
|---|---|---|---|---|---|
| | | PGQGLEWMGHIYYS GNTNYNPSLKSRVT MTRDTSTSTVYMELS SLRSEDTAVYYCARD RVTGAFDIWGQGTL VTVSS | | KPGKAPKLLIYD ASNLETGVPSRFS GSGSGTDFTFTISS LQPEDIATYYCQ HFDHLPLAFGQG TKVEIK | |
| EGFR.31 | AC2879 | QVQLVQSGAEVKKP GSSVKVSCKASGGSV SSGDYYWTWVRQAP GQGLEWMGHIYYSG NTNYNPSLKSRVTIT ADESTSTAYMELSSL RSEDTAVYYCARDR VTGAFDIWGQGTLVT VSS | 456 | DIQMTQSPSSLSA SVGDRVTITCQAS QDISNYLNWYQQ KPGKAPKLLIYD ASNLETGVPSRFS GSGSGTDFTFTISS LQPEDIATYYCQ HFDHLPLAFGQG TKVEIK | 457 |
| EGFR.32 | AC2880 | EVQLLESGGGLVQPG GSLRLSCAASGGSVS SGDYYWTWVRQAPG KGLEWVSHIYYSGNT NYNPSLKSRFTISRDN SKNTLYLQMNSLRAE DTAVYYCAKDRVTG AFDIWGQGTLVTVSS | 458 | DIQMTQSPSSLSA SVGDRVTITCQAS QDISNYLNWYQQ KPGKAPKLLIYD ASNLETGVPSRFS GSGSGTDFTFTISS LQPEDIATYYCQ HFDHLPLAFGQG TKVEIK | 459 |
| EGFR.33 | AC2881 | QVQLVESGGGVVQP GRSLRLSCAASGGSV SSGDYYWTWVRQAP GKGLEWVAHIYYSG NTNYNPSLKSRFTISR DNSKNTLYLQMNSL RAEDTAVYYCARDR VTGAFDIWGQGTLVT VSS | 460 | DIQMTQSPSSLSA SVGDRVTITCQAS QDISNYLNWYQQ KPGKAPKLLIYD ASNLETGVPSRFS GSGSGTDFTFTISS LQPEDIATYYCQ HFDHLPLAFGQG TKVEIK | 461 |
| EGFR.34 | AC2882 | EVQLVESGGGLVQPG GSLRLSCAASGGSVS SGDYYWTWVRQAPG KGLEWVAHIYYSGN TNYNPSLKSRFTISRD NAKNSLYLQMNSLR AEDTAVYYCARDRV TGAFDIWGQGTLVTV SS | 462 | DIQMTQSPSSLSA SVGDRVTITCQAS QDISNYLNWYQQ KPGKAPKLLIYD ASNLETGVPSRFS GSGSGTDFTFTISS LQPEDIATYYCQ HFDHLPLAFGQG TKVEIK | 463 |
| EGFR.35 | AC2883 | EVQLVESGGGLVQPG GSLRLSCAASGGSVS SGDYYWTWVRQAPG KGLEWVSHIYYSGNT NYNPSLKSRFTISRDN SKNTLYLQMNSLRAE DTAVYYCARDRVTG AFDIWGQGTLVTVSS | 464 | DIQMTQSPSSLSA SVGDRVTITCQAS QDISNYLNWYQQ KPGKAPKLLIYD ASNLETGVPSRFS GSGSGTDFTFTISS LQPEDIATYYCQ HFDHLPLAFGQG TKVEIK | 465 |
| EGFR.36 | AC2884 | QVQLQQWGAGLLKP SETLSLTCAVYGGSV SSGDYYWTWIRQPPG KGLEWIGHIYYSGNT NYNPSLKSRVTISVD TSKNQFSLKLSSVTA ADTAVYYCARDRVT GAFDIWGQGTLVTVS S | 466 | DIQMTQSPSSLSA SVGDRVTITCQAS QDISNYLNWYQQ KPGKAPKLLIYD ASNLETGVPSRFS GSGSGTDFTFTISS LQPEDIATYYCQ HFDHLPLAFGQG TKVEIK | 467 |
| EGFR.37 | AC2885 | QVQLQESGPGLVKPS ETLSLTCTVSGGSVSS GDYYWTWIRQPPGK GLEWIGHIYYSGNTN YNPSLKSRVTISVDTS KNQFSLKLSSVTAAD TAVYYCARDRVTGA | 468 | DIQMTQSPSSLSA SVGDRVTITCQAS QDISNYLNWYQQ KPGKAPKLLIYD ASNLETGVPSRFS GSGSGTDFTFTISS LQPEDIATYYCQ | 469 |

TABLE 5f-continued

Anti-EGFR VH and VL Sequences

| Antibody Name | AC Number | VH Sequence | SEQ ID NO: | VL Sequence | SEQ ID NO: |
|---|---|---|---|---|---|
| | | FDIWGQGTLVTVSS | | HFDHLPLAFGQG TKVEIK | |
| EGFR.38 | AC2886 | EVQLVQSGAEVKKP GESLKISCKGSGGSVS SGDYYWTWVRQMP GKGLEWMGHIYYSG NTNYNPSLKSQVTIS ADKSISTAYLQWSSL KASDTAMYYCARDR VTGAFDIWGQGTLVT VSS | 470 | DIQMTQSPSSLSA SVGDRVTITCQAS QDISNYLNWYQQ KPGKAPKLLIYD ASNLETGVPSRFS GSGSGTDFTFTISS LQPEDIATYYCQ HFDHLPLAFGQG TKVEIK | 471 |
| EGFR.39 | AC2887 | QVQLVQSGSELKKPG ASVKVSCKASGGSVS SGDYYWTWVRQAPG QGLEWMGHIYYSGN TNYNPSLKSRFVFSL DTSVSTAYLQICSLK AEDTAVYYCARDRV TGAFDIWGQGTLVTV SS | 472 | DIQMTQSPSSLSA SVGDRVTITCQAS QDISNYLNWYQQ KPGKAPKLLIYD ASNLETGVPSRFS GSGSGTDFTFTISS LQPEDIATYYCQ HFDHLPLAFGQG TKVEIK | 473 |
| EGFR.40 | AC2888 | QVQLVQSGVEVKKP GASVKVSCKASGGS VSSGDYYWTWVRQA PGQGLEWMGHIYYS GNTNYNPSLKSRVTL TTDSSTTTAYMELKS LQFDDTAVYYCARD RVTGAFDIWGQGTL VTVSS | 474 | DIQMTQSPSSLSA SVGDRVTITCQAS QDISNYLNWYQQ KPGKAPKLLIYD ASNLETGVPSRFS GSGSGTDFTFTISS LQPEDIATYYCQ HFDHLPLAFGQG TKVEIK | 475 |
| EGFR.41 | AC2889 | QVQLVQSGAEVKKP GASVKVSCKASGGS VSSGDYYWTWVRQA PGQGLEWMGHIYYS GNTNYNPSLKSRVTS TRDTSISTAYMELSRL RSDDTVVYYCARDR VTGAFDIWGQGTLVT VSS | 476 | DIQMTQSPSSLSA SVGDRVTITCQAS QDISNYLNWYQQ KPGKAPKLLIYD ASNLETGVPSRFS GSGSGTDFTLTIS SLQPEDFATYYC QHFDHLPLAFGQ GTKVEIK | 477 |
| EGFR.42 | AC2890 | QVQLVQSGAEVKKP GASVKVSCKASGGS VSSGDYYWTWVRQA PGQGLEWMGHIYYS GNTNYNPSLKSRVT MTRDTSTSTVYMELS SLRSEDTAVYYCARD RVTGAFDIWGQGTL VTVSS | 478 | DIQMTQSPSSLSA SVGDRVTITCQAS QDISNYLNWYQQ KPGKAPKLLIYD ASNLETGVPSRFS GSGSGTDFTLTIS SLQPEDFATYYC QHFDHLPLAFGQ GTKVEIK | 479 |
| EGFR.43 | AC2891 | QVQLVQSGAEVKKP GSSVKVSCKASGGSV SSGDYYWTWVRQAP GQGLEWMGHIYYSG NTNYNPSLKSRVTIT ADESTSTAYMELSSL RSEDTAVYYCARDR VTGAFDIWGQGTLVT VSS | 480 | DIQMTQSPSSLSA SVGDRVTITCQAS QDISNYLNWYQQ KPGKAPKLLIYD ASNLETGVPSRFS GSGSGTDFTLTIS SLQPEDFATYYC QHFDHLPLAFGQ GTKVEIK | 481 |
| EGFR.44 | AC2892 | EVQLLESGGGLVQPG GSLRLSCAASGGSVS SGDYYWTWVRQAPG KGLEWVSHIYYSGNT NYNPSLKSRFTISRDN SKNTLYLQMNSLRAE DTAVYYCAKDRVTG AFDIWGQGTLVTVSS | 482 | DIQMTQSPSSLSA SVGDRVTITCQAS QDISNYLNWYQQ KPGKAPKLLIYD ASNLETGVPSRFS GSGSGTDFTLTIS SLQPEDFATYYC QHFDHLPLAFGQ GTKVEIK | 483 |
| EGFR.45 | AC2893 | QVQLVESGGGVVQP GRSLRLSCAASGGSV | 484 | DIQMTQSPSSLSA SVGDRVTITCQAS | 485 |

TABLE 5f-continued

Anti-EGFR VH and VL Sequences

| Antibody Name | AC Number | VH Sequence | SEQ ID NO: | VL Sequence | SEQ ID NO: |
|---|---|---|---|---|---|
| | | SSGDYYWTWVRQAP GKGLEWVAHIYYSG NTNYNPSLKSRFTISR DNSKNTLYLQMNSL RAEDTAVYYCARDR VTGAFDIWGQGTLVT VSS | | QDISNYLNWYQQ KPGKAPKLLIYD ASNLETGVPSRFS GSGSGTDFTLTIS SLQPEDFATYYC QHFDHLPLAFGQ GTKVEIK | |
| EGFR.46 | AC2894 | EVQLVESGGGLVQPG GSLRLSCAASGGSVS SGDYYWTWVRQAPG KGLEWVAHIYYSGN TNYNPSLKSRFTISRD NAKNSLYLQMNSLR AEDTAVYYCARDRV TGAFDIWGQGTLVTV SS | 486 | DIQMTQSPSSLSA SVGDRVTITCQAS QDISNYLNWYQQ KPGKAPKLLIYD ASNLETGVPSRFS GSGSGTDFTLTIS SLQPEDFATYYC QHFDHLPLAFGQ GTKVEIK | 487 |
| EGFR.47 | AC2895 | EVQLVESGGGLVQPG GSLRLSCAASGGSVS SGDYYWTWVRQAPG KGLEWVSHIYYSGNT NYNPSLKSRFTISRDN SKNTLYLQMNSLRAE DTAVYYCARDRVTG AFDIWGQGTLVTVSS | 488 | DIQMTQSPSSLSA SVGDRVTITCQAS QDISNYLNWYQQ KPGKAPKLLIYD ASNLETGVPSRFS GSGSGTDFTLTIS SLQPEDFATYYC QHFDHLPLAFGQ GTKVEIK | 489 |
| EGFR.48 | AC2896 | QVQLQQWGAGLLKP SETLSLTCAVYGGSV SSGDYYWTWIRQPPG KGLEWIGHIYYSGNT NYNPSLKSRVTISVD TSKNQFSLKLSSVTA ADTAVYYCARDRVT GAFDIWGQGTLVTVS S | 490 | DIQMTQSPSSLSA SVGDRVTITCQAS QDISNYLNWYQQ KPGKAPKLLIYD ASNLETGVPSRFS GSGSGTDFTLTIS SLQPEDFATYYC QHFDHLPLAFGQ GTKVEIK | 491 |
| EGFR.49 | AC2897 | QVQLQESGPGLVKPS ETLSLTCTVSGGSVSS GDYYWTWIRQPPGK GLEWIGHIYYSGNTN YNPSLKSRVTISVDTS KNQFSLKLSSVTAAD TAVYYCARDRVTGA FDIWGQGTLVTVSS | 492 | DIQMTQSPSSLSA SVGDRVTITCQAS QDISNYLNWYQQ KPGKAPKLLIYD ASNLETGVPSRFS GSGSGTDFTLTIS SLQPEDFATYYC QHFDHLPLAFGQ GTKVEIK | 493 |
| EGFR.50 | AC2898 | EVQLVQSGAEVKKP GESLKISCKGSGGSVS SGDYYWTWVRQMP GKGLEWMGHIYYSG NTNYNPSLKSQVTIS ADKSISTAYLQWSSL KASDTAMYYCARDR VTGAFDIWGQGTLVT VSS | 494 | DIQMTQSPSSLSA SVGDRVTITCQAS QDISNYLNWYQQ KPGKAPKLLIYD ASNLETGVPSRFS GSGSGTDFTLTIS SLQPEDFATYYC QHFDHLPLAFGQ GTKVEIK | 495 |
| EGFR.51 | AC2899 | QVQLVQSGSELKKPG ASVKVSCKASGGSVS SGDYYWTWVRQAPG QGLEWMGHIYYSGN TNYNPSLKSRFVFSL DTSVSTAYLQICSLK AEDTAVYYCARDRV TGAFDIWGQGTLVTV SS | 496 | DIQMTQSPSSLSA SVGDRVTITCQAS QDISNYLNWYQQ KPGKAPKLLIYD ASNLETGVPSRFS GSGSGTDFTLTIS SLQPEDFATYYC QHFDHLPLAFGQ GTKVEIK | 497 |
| EGFR.52 | AC2900 | QVQLVQSGVEVKKP GASVKVSCKASGGS VSSGDYYWTWVRQA PGQGLEWMGHIYYS GNTNYNPSLKSRVTL TTDSSTTTAYMELKS LQFDDTAVYYCARD | 498 | DIQMTQSPSSLSA SVGDRVTITCQAS QDISNYLNWYQQ KPGKAPKLLIYD ASNLETGVPSRFS GSGSGTDFTLTIS SLQPEDFATYYC | 499 |

US 12,590,159 B2

TABLE 5f-continued

Anti-EGFR VH and VL Sequences

| Antibody Name | AC Number | VH Sequence | SEQ ID NO: | VL Sequence | SEQ ID NO: |
|---|---|---|---|---|---|
| | | RVTGAFDIWGQGTL VTVSS | | QHFDHLPLAFGQ GTKVEIK | |
| EGFR.53 | AC2901 | QVQLVQSGAEVKKP GASVKVSCKASGGS VSSGDYYWTWVRQA PGQGLEWMGHIYYS GNTNYNPSLKSRVTS TRDTSISTAYMELSRL RSDDTVVYYCARDR VTGAFDIWGQGTLVT VSS | 500 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 501 |
| EGFR.54 | AC2902 | QVQLVQSGAEVKKP GASVKVSCKASGGS VSSGDYYWTWVRQA PGQGLEWMGHIYYS GNTNYNPSLKSRVT MTRDTSTSTVYMELS SLRSEDTAVYYCARD RVTGAFDIWGQGTL VTVSS | 502 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 503 |
| EGFR.55 | AC2903 | QVQLVQSGAEVKKP GSSVKVSCKASGGSV SSGDYYWTWVRQAP GQGLEWMGHIYYSG NTNYNPSLKSRVTIT ADESTSTAYMELSSL RSEDTAVYYCARDR VTGAFDIWGQGTLVT VSS | 504 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 505 |
| EGFR.56 | AC2904 | EVQLLESGGGLVQPG GSLRLSCAASGGSVS SGDYYWTWVRQAPG KGLEWVSHIYYSGNT NYNPSLKSRFTISRDN SKNTLYLQMNSLRAE DTAVYYCAKDRVTG AFDIWGQGTLVTVSS | 506 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 507 |
| EGFR.57 | AC2905 | QVQLVESGGGVVQP GRSLRLSCAASGGSV SSGDYYWTWVRQAP GKGLEWVAHIYYSG NTNYNPSLKSRFTISR DNSKNTLYLQMNSL RAEDTAVYYCARDR VTGAFDIWGQGTLVT VSS | 508 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 509 |
| EGFR.58 | AC2906 | EVQLVESGGGLVQPG GSLRLSCAASGGSVS SGDYYWTWVRQAPG KGLEWVAHIYYSGN TNYNPSLKSRFTISRD NAKNSLYLQMNSLR AEDTAVYYCARDRV TGAFDIWGQGTLVTV SS | 510 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 511 |
| EGFR.59 | AC2907 | EVQLVESGGGLVQPG GSLRLSCAASGGSVS SGDYYWTWVRQAPG KGLEWVSHIYYSGNT NYNPSLKSRFTISRDN SKNTLYLQMNSLRAE DTAVYYCARDRVTG AFDIWGQGTLVTVSS | 512 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 513 |
| EGFR.60 | AC2908 | QVQLQQWGAGLLKP SETLSLTCAVYGGSV | 514 | EIVLTQSPGTLSLS PGERATLSCQAS | 515 |

TABLE 5f-continued

Anti-EGFR VH and VL Sequences

| Antibody Name | AC Number | VH Sequence | SEQ ID NO: | VL Sequence | SEQ ID NO: |
|---|---|---|---|---|---|
| | | SSGDYYWTWIRQPPG KGLEWIGHIYYSGNT NYNPSLKSRVTISVD TSKNQFSLKLSSVTA ADTAVYYCARDRVT GAFDIWGQGTLVTVS S | | QDISNYLNWYQQ KPGQAPRLLIYDA SNLETGIPDRFSG SGSGTDFTLTISR LEPEDFAVYYCQ HFDHLPLAFGQG TKVEIK | |
| EGFR.61 | AC2909 | QVQLQESGPGLVKPS ETLSLTCTVSGGSVSS GDYYWTWIRQPPGK GLEWIGHIYYSGNTN YNPSLKSRVTISVDTS KNQFSLKLSSVTAAD TAVYYCARDRVTGA FDIWGQGTLVTVSS | 516 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 517 |
| EGFR.62 | AC2910 | EVQLVQSGAEVKKP GESLKISCKGSGGSVS SGDYYWTWVRQMP GKGLEWMGHIYYSG NTNYNPSLKSQVTIS ADKSISTAYLQWSSL KASDTAMYYCARDR VTGAFDIWGQGTLVT VSS | 518 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 519 |
| EGFR.63 | AC2911 | QVQLVQSGSELKKPG ASVKVSCKASGGSVS SGDYYWTWVRQAPG QGLEWMGHIYYSGN TNYNPSLKSRFVFSL DTSVSTAYLQICSLK AEDTAVYYCARDRV TGAFDIWGQGTLVTV SS | 520 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 521 |
| EGFR.64 | AC2912 | QVQLVQSGVEVKKP GASVKVSCKASGGS VSSGDYYWTWVRQA PGQGLEWMGHIYYS GNTNYNPSLKSRVTL TTDSSTTTAYMELKS LQFDDTAVYYCARD RVTGAFDIWGQGTL VTVSS | 522 | EIVLTQSPGTLSLS PGERATLSCQAS QDISNYLNWYQQ KPGQAPRLLIYDA SNLETGIPDRFSG SGSGTDFTLTISR LEPEDFAVYYCQ HFDHLPLAFGQG TKVEIK | 523 |
| EGFR.65 | AC2913 | QVQLVQSGAEVKKP GASVKVSCKASGGS VSSGDYYWTWVRQA PGQGLEWMGHIYYS GNTNYNPSLKSRVTS TRDTSISTAYMELSRL RSDDTVVYYCARDR VTGAFDIWGQGTLVT VSS | 524 | EIVLTQSPATLSLS PGERATLSCQAS QDISNYLNWYQQ KPGQAPRLLIYDA SNLETGIPARFSG SGSGTDFTLTISSL EPEDFAVYYCQH FDHLPLAFGQGT KVEIK | 525 |
| EGFR.66 | AC2914 | QVQLVQSGAEVKKP GASVKVSCKASGGS VSSGDYYWTWVRQA PGQGLEWMGHIYYS GNTNYNPSLKSRVT MTRDTSTSTVYMELS SLRSEDTAVYYCARD RVTGAFDIWGQGTL VTVSS | 526 | EIVLTQSPATLSLS PGERATLSCQAS QDISNYLNWYQQ KPGQAPRLLIYDA SNLETGIPARFSG SGSGTDFTLTISSL EPEDFAVYYCQH FDHLPLAFGQGT KVEIK | 527 |
| EGFR.67 | AC2915 | QVQLVQSGAEVKKP GSSVKVSCKASGGSV SSGDYYWTWVRQAP GQGLEWMGHIYYSG NTNYNPSLKSRVTIT ADESTSTAYMELSSL RSEDTAVYYCARDR | 528 | EIVLTQSPATLSLS PGERATLSCQAS QDISNYLNWYQQ KPGQAPRLLIYDA SNLETGIPARFSG SGSGTDFTLTISSL EPEDFAVYYCQH | 529 |

TABLE 5f-continued

Anti-EGFR VH and VL Sequences

| Antibody Name | AC Number | VH Sequence | SEQ ID NO: | VL Sequence | SEQ ID NO: |
|---|---|---|---|---|---|
| | | VTGAFDIWGQGTLVT VSS | | FDHLPLAFGQGT KVEIK | |
| EGFR.68 | AC2916 | EVQLLESGGGLVQPG GSLRLSCAASGGSVS SGDYYWTWVRQAPG KGLEWVSHIYYSGNT NYNPSLKSRFTISRDN SKNTLYLQMNSLRAE DTAVYYCAKDRVTG AFDIWGQGTLVTVSS | 530 | EIVLTQSPATLSLS PGERATLSCQAS QDISNYLNWYQQ KPGQAPRLLIYDA SNLETGIPARFSG SGSGTDFTLTISSL EPEDFAVYYCQH FDHLPLAFGQGT KVEIK | 531 |
| EGFR.69 | AC2917 | QVQLVESGGGVVQP GRSLRLSCAASGGSV SSGDYYWTWVRQAP GKGLEWVAHIYYSG NTNYNPSLKSRFTISR DNSKNTLYLQMNSL RAEDTAVYYCARDR VTGAFDIWGQGTLVT VSS | 532 | EIVLTQSPATLSLS PGERATLSCQAS QDISNYLNWYQQ KPGQAPRLLIYDA SNLETGIPARFSG SGSGTDFTLTISSL EPEDFAVYYCQH FDHLPLAFGQGT KVEIK | 533 |
| EGFR.70 | AC2918 | EVQLVESGGGLVQPG GSLRLSCAASGGSVS SGDYYWTWVRQAPG KGLEWVAHIYYSGN TNYNPSLKSRFTISRD NAKNSLYLQMNSLR AEDTAVYYCARDRV TGAFDIWGQGTLVTV SS | 534 | EIVLTQSPATLSLS PGERATLSCQAS QDISNYLNWYQQ KPGQAPRLLIYDA SNLETGIPARFSG SGSGTDFTLTISSL EPEDFAVYYCQH FDHLPLAFGQGT KVEIK | 535 |
| EGFR.71 | AC2919 | EVQLVESGGGLVQPG GSLRLSCAASGGSVS SGDYYWTWVRQAPG KGLEWVSHIYYSGNT NYNPSLKSRFTISRDN SKNTLYLQMNSLRAE DTAVYYCARDRVTG AFDIWGQGTLVTVSS | 536 | EIVLTQSPATLSLS PGERATLSCQAS QDISNYLNWYQQ KPGQAPRLLIYDA SNLETGIPARFSG SGSGTDFTLTISSL EPEDFAVYYCQH FDHLPLAFGQGT KVEIK | 537 |
| EGFR.72 | AC2920 | QVQLQQWGAGLLKP SETLSLTCAVYGGSV SSGDYYWTWIRQPPG KGLEWIGHIYYSGNT NYNPSLKSRVTISVD TSKNQFSLKLSSVTA ADTAVYYCARDRVT GAFDIWGQGTLVTVS S | 538 | EIVLTQSPATLSLS PGERATLSCQAS QDISNYLNWYQQ KPGQAPRLLIYDA SNLETGIPARFSG SGSGTDFTLTISSL EPEDFAVYYCQH FDHLPLAFGQGT KVEIK | 539 |
| EGFR.73 | AC2921 | QVQLQESGPGLVKPS ETLSLTCTVSGGSVSS GDYYWTWIRQPPGK GLEWIGHIYYSGNTN YNPSLKSRVTISVDTS KNQFSLKLSSVTAAD TAVYYCARDRVTGA FDIWGQGTLVTVSS | 540 | EIVLTQSPATLSLS PGERATLSCQAS QDISNYLNWYQQ KPGQAPRLLIYDA SNLETGIPARFSG SGSGTDFTLTISSL EPEDFAVYYCQH FDHLPLAFGQGT KVEIK | 541 |
| EGFR.74 | AC2922 | EVQLVQSGAEVKKP GESLKISCKGSGGSVS SGDYYWTWVRQMP GKGLEWMGHIYYSG NTNYNPSLKSQVTIS ADKSISTAYLQWSSL KASDTAMYYCARDR VTGAFDIWGQGTLVT VSS | 542 | EIVLTQSPATLSLS PGERATLSCQAS QDISNYLNWYQQ KPGQAPRLLIYDA SNLETGIPARFSG SGSGTDFTLTISSL EPEDFAVYYCQH FDHLPLAFGQGT KVEIK | 543 |
| EGFR.75 | AC2923 | QVQLVQSGSELKKPG ASVKVSCKASGGSVS | 544 | EIVLTQSPATLSLS PGERATLSCQAS | 545 |

TABLE 5f-continued

Anti-EGFR VH and VL Sequences

| Antibody Name | AC Number | VH Sequence | SEQ ID NO: | VL Sequence | SEQ ID NO: |
|---|---|---|---|---|---|
| | | SGDYYWTWVRQAPG QGLEWMGHIYYSGN TNYNPSLKSRFVFSL DTSVSTAYLQICSLK AEDTAVYYCARDRV TGAFDIWGQGTLVTV SS | | QDISNYLNWYQQ KPGQAPRLLIYDA SNLETGIPARFSG SGSGTDFTLTISSL EPEDFAVYYCQH FDHLPLAFGQGT KVEIK | |
| EGFR.76 | AC2924 | QVQLVQSGVEVKKP GASVKVSCKASGGS VSSGDYYWTWVRQA PGQGLEWMGHIYYS GNTNYNPSLKSRVTL TTDSSTTTAYMELKS LQFDDTAVYYCARD RVTGAFDIWGQGTL VTVSS | 546 | EIVLTQSPATLSLS PGERATLSCQAS QDISNYLNWYQQ KPGQAPRLLIYDA SNLETGIPARFSG SGSGTDFTLTISSL EPEDFAVYYCQH FDHLPLAFGQGT KVEIK | 547 |
| EGFR.81 | AC2925 | QVQLVESGGGVVQP GRSLRLSCAASGGSV SSGDYYWTWVRQAP GKGLEWVAHIYYSG NTNYNPSLKSRLTISR DNSKNTLYLQMNSL RAEDTAVYYCVRDR VTGAFDIWGQGTLVT VSS | 548 | DIQMTQSPSSLSA SVGDRVTITCQAS QDISNYLNWYQQ KPGKAPKLLIYD ASNLETGVPSRFS GSGSGTDFTLTIS SLQPEDFATYFCQ HFDHLPLAFGQG TKVEIK | 549 |
| EGFR.82 | AC2926 | EVQLVESGGGLVQPG GSLRLSCAASGGSVS SGDYYWTWVRQAPG KGLEWVAHIYYSGN TNYNPSLKSRLTISRD NAKNSLYLQMNSLR AEDTAVYYCVRDRV TGAFDIWGQGTLVTV SS | 550 | DIQMTQSPSSLSA SVGDRVTITCQAS QDISNYLNWYQQ KPGKAPKLLIYD ASNLETGVPSRFS GSGSGTDFTLTIS SLQPEDFATYFCQ HFDHLPLAFGQG TKVEIK | 551 |
| EGFR.83 | AC2927 | QVQLVQSGAEVKKP GSSVKVSCKASGGSV SSGDYYWTWVRQAP GQGLEWMGHIYYSG NTNYNPSLKSRLTITA DESTSTAYMELSSLR SEDTAVYYCVRDRV TGAFDIWGQGTLVTV SS | 552 | DIQMTQSPSSLSA SVGDRVTITCQAS QDISNYLNWYQQ KPGKAPKLLIYD ASNLETGVPSRFS GSGSGTDFTLTIS SLQPEDFATYFCQ HFDHLPLAFGQG TKVEIK | 553 |
| EGFR.84 | AC2928 | QVQLVESGGGVVQP GRSLRLSCAASGGSV SSGDYYWTWVRQAP GKGLEWVAHIYYSG NTNYNPSLKSRLTISR DNSKNTLYLQMNSL RAEDTAVYYCVRDR VTGAFDIWGQGTLVT VSS | 554 | DIQMTQSPSSLSA SVGDRVTITCQAS QDISNYLNWYQQ KPGKAPKLLIYD ASNLETGVPSRFS GSGSGTDFTFTISS LQPEDIATYFCQH FDHLPLAFGQGT KVEIK | 555 |
| EGFR.85 | AC2929 | EVQLVESGGGLVQPG GSLRLSCAASGGSVS SGDYYWTWVRQAPG KGLEWVAHIYYSGN TNYNPSLKSRLTISRD NAKNSLYLQMNSLR AEDTAVYYCVRDRV TGAFDIWGQGTLVTV SS | 556 | DIQMTQSPSSLSA SVGDRVTITCQAS QDISNYLNWYQQ KPGKAPKLLIYD ASNLETGVPSRFS GSGSGTDFTFTISS LQPEDIATYFCQH FDHLPLAFGQGT KVEIK | 557 |
| EGFR.86 | AC2930 | QVQLVQSGAEVKKP GSSVKVSCKASGGSV SSGDYYWTWVRQAP GQGLEWMGHIYYSG NTNYNPSLKSRLTITA DESTSTAYMELSSLR SEDTAVYYCVRDRV | 558 | DIQMTQSPSSLSA SVGDRVTITCQAS QDISNYLNWYQQ KPGKAPKLLIYD ASNLETGVPSRFS GSGSGTDFTFTISS LQPEDIATYFCQH | 559 |

TABLE 5f-continued

Anti-EGFR VH and VL Sequences

| Antibody Name | AC Number | VH Sequence | SEQ ID NO: | VL Sequence | SEQ ID NO: |
|---|---|---|---|---|---|
| | | TGAFDIWGQGTLVTV SS | | FDHLPLAFGQGT KVEIK | |
| EGFR.87 | AC2931 | QVQLQESGPGLVKPS ETLSLTCTVSGGSVSS GDYYWTWIRQSPGK GLEWIGHIYYSGNTN YNPSLKSRLTISIDTS KTQFSLKLSSVTAAD TAIYYCVRDRVTGAF DIWGQGTLVTVSS | 560 | DIQMTQSPSSLSA SVGDRVTITCQAS QDISNYLNWYQQ KPGKAPKLLIYD ASNLETGVPSRFS GSGSGTDFTFTISS LQPEDIATYFCQH FDHLPLAFGQGT KVEIK | 561 |

In certain embodiments, an anti-EGFR VH domain comprises an amino acid sequence of QVQLQX₁X₂GX₃GLX₄KPSETLSLTCXsVX₆GGSVSSG DYYWTWIRQPPGKGLEWIGHIYYSGNTN YNPSLKSRVTISVDTSKNQFSLKLSSVTAADTAVYY-CARDRVTGAFDIWGQGTLVTVSS, wherein $X_1$ corresponds to E or Q; $X_2$ corresponds to S or W; $X_3$ corresponds to P or A; $X_4$ corresponds to V or L; $X_5$ corresponds to T or A; and $X_6$ corresponds to S or Y (SEQ ID NO: 576); and an anti-EGFR a VL domain comprises an amino acid sequence of X₁IX₂X₃TQSPX₄XSLSX₆SX-GX₈RXₙTX₁₀X₁CQASQDISNYLNWYQQKPGX₁₂APX₁₃ LLIYDASNLET GX₁₄PX₁₅RFSGSGSGTDFTX₁₆TISX₁₇LX₁₈PEDX₁₉AX₂₀ YYCQHFDHLPLAFGQGTKVEIK, wherein $X_1$ corresponds to D or E; $X_2$ corresponds to Q or V; $X_3$ corresponds to M or L; $X_4$ corresponds to S, G, or A; $X_5$ corresponds to S or T; $X_6$ corresponds to L or A; $X_7$ corresponds to P or V; $X_8$ corresponds to D or E; $X_9$ corresponds to V or A; $X_{10}$ corresponds to I or L; $X_{11}$ corresponds to T or S; $X_{12}$ corresponds to K or Q; $X_{13}$ corresponds to K or R; $X_{14}$ corresponds to V or I; $X_{15}$ corresponds to S, D, or A; $X_{16}$ corresponds to F or L; $X_{17}$ corresponds to S or R; $X_{18}$ corresponds to Q or E; $X_{19}$ corresponds to I or F; and $X_{20}$ corresponds to T or V (SEQ ID NO: 577);

Each EGFR antibody recited in Table 5f contains the following CDR sequences:

```
HCDR1
                              (SEQ ID NO: 562)
GGSVSSGDYYWT

HCDR2
                              (SEQ ID NO: 563)
HIYYSGNTNYNPSLKS

HCDR3
                              (SEQ ID NO: 564)
DRVTGAFDI

LCDR1
                              (SEQ ID NO: 565)
QASQDISNYLN

LCDR2
                              (SEQ ID NO: 566)
DASNLET

LCDR3
                              (SEQ ID NO: 567)
QHFDHLPLA
```

In some embodiments, the disclosure provides an anti-EGFR antibody VH region comprising the following CDRs: a VH region CDR1 with an amino acid sequence that has at least 85%, 90%, 91%, 92%, 93%, 94%, 95%, 96%, 97%, 98%, or 99% identity, or 100% identity, to GGSVSSGDYYWT (SEQ ID NO: 562); a VH region CDR2 with an amino acid sequence that that has at least 85%, 90%, 91%, 92%, 93%, 94%, 95%, 96%, 97%, 98%, or 99% identity, or 100% identity, to HIYYSGNTNYNPSLKS (SEQ ID NO: 563); and a VH region CDR3 with an amino acid sequence that has at least 85%, 90%, 91%, 92%, 93%, 94%, 95%, 96%, 97%, 98%, or 99% identity, or 100% identity, to DRVTGAFDI (SEQ ID NO:564).

In some embodiments, the disclosure provides an anti-EGFR antibody VL region comprising the following CDRs: a VL region CDR1 with an amino acid sequence that has at least 85%, 90%, 91%, 92%, 93%, 94%, 95%, 96%, 97%, 98%, or 99% identity, or 100% identity, to QASQDISNYLN (SEQ ID NO: 565); a VL region CDR2 with an amino acid sequence that that has at least 85%, 90%, 91%, 92%, 93%, 94%, 95%, 96%, 97%, 98%, or 99% identity, or 100% identity, to DASNLET (SEQ ID NO:566); and a VL region CDR3 with an amino acid sequence that has at least 85%, 90%, 91%, 92%, 93%, 94%, 95%, 96%, 97%, 98%, or 99% identity, or 100% identity, to QHFDHLPLA (SEQ ID NO:567).

In some embodiments, the anti-EGFR antibody VH region comprises the following framework regions (FRs): a VH region FR1 with an amino acid sequence that has at least 85%, 90%, 91%, 92%, 93%, 94%, 95%, 96%, 97%, 98%, or 99% identity, or 100% identity, to QVQLQESGPGLVKP-SETLSLTCTVS (SEQ ID NO:8206); a VH region FR2 with an amino acid sequence that has at least 85%, 90%, 91%, 92%, 93%, 94%, 95%, 96%, 97%, 98%, or 99% identity, or 100% identity, to WIRQPPGKGLEWIG (SEQ ID NO: 8207); a VH region FR3 with an amino acid sequence that has at least 85%, 90%, 91%, 92%, 93%, 94%, 95%, 96%, 97%, 98%, or 99% identity, or 100% identity, to RVTISVDTSKNQFSLKLSSVTAADTAVYYCAR (SEQ ID NO:8208); and a VH region FR4 with an amino acid sequence that has at least 85%, 90%, 91%, 92%, 93%, 94%, 95%, 96%, 97%, 98%, or 99% identity, or 100% identity, to WGQGTLVTVSS (SEQ ID NO:67).

In some embodiments, the anti-EGFR antibody VL region comprises the following framework regions (FRs): a VL region FR1 with an amino acid sequence that has at least 85%, 90%, 91%, 92%, 93%, 94%, 95%, 96%, 97%, 98%, or 99% identity, or 100% identity, to DIQMTQSPSSL-SASVGDRVTITC (SEQ ID NO:8209); a VL region FR2 with an amino acid sequence that has at least 85%, 90%, 91%, 92%, 93%, 94%, 95%, 96%, 97%, 98%, or 99% identity, or 100% identity, to WYQQKPGKAPKLLIY (SEQ ID NO:8210); a VL region FR3 with an amino acid sequence that has at least 85%, 90%, 91%, 92%, 93%, 94%, 95%, 96%, 97%, 98%, or 99% identity, or 100% identity, to GVPSRFSGSGSGTDFTFTISSLQPEDIATYYC (SEQ ID NO:8211); and a VL region FR4 with an amino acid sequence that has at least 85%, 90%, 91%, 92%, 93%, 94%, 95%, 96%, 97%, 98%, or 99% identity, or 100% identity, to FGQGTKVEIK (SEQ ID NO:8212).

In some embodiments, the disclosure provides an anti-EGFR antibody VH region comprising the sequence QVQLQESGPGLVKP-SETLSLTCTVSGGSVSSGDYYWTWIRQPPGK-GLEWIGHIYYSGNT NYNPSLKSRVTISVDTSKNQFSLKLSSVTAADTAVYY-CARDRVTGAFDIWGQGTLVTVSS (SEQ ID NO: 468), or the CDRs thereof; and an anti-EGFR antibody VL region comprising the sequence DIQMTQSPSSL-SASVGDRVTITCQASQDIS-NYLNWYQQKPGKAPKLLIYDASNLETGVPSRFSGS GSGTDFTFTISSLQPEDIATYYCQHFDHL-PLAFGQGTKVEIK (SEQ ID NO: 469), or the CDRs thereof.

In some embodiments, the disclosure provides an anti-EGFR binding domain (e.g., scFv) comprising a sequence that has at least 85%, 90%, 91%, 92%, 93%, 94%, 95%, 96%, 97%, 98%, or 99% identity, or 100% identity to

```
                                      (SEQ ID NO: 449)
DIQMTQSPSSLSASVGDRVTITCQASQDISNYLNWYQQKPGKAPKLLIYD

ASNLETGVPSRFSGSGSGTDFTFTISSLQPEDIATYYCQHFDHLPLAFGQ

GTKVEIKSESATPESGPGTSPGATPESGPGTSESATPQVQLQESGPGLVK

PSETLSLTCTVSGGSVSSGDYYWTWIRQPPGKGLEWIGHIYYSGNTNYNP

SLKSRVTISVDTSKNQFSLKLSSVTAADTAVYYCARDRVTGAFDIWGQGT

LVTVSS.
```

In some embodiments, the VL and VH of the antigen binding fragments (e.g., of Table 5f) are fused by relatively long linkers, consisting of 25, 26, 27, 28, 29, 30, 31, 32, 33, 34, or 35 hydrophilic amino acids that, when joined together, have a flexible characteristic. In some embodiments, the VL and VH of any of the scFv embodiments described herein (e.g., of Table 5f) are linked by a relatively long linker having the sequence SESATPESGPGTSPGATPESGPGTS-ESATP (SEQ ID NO: 81). In some embodiments, the VL and VH of any of the scFv embodiments described herein are linked by relatively long linkers of hydrophilic amino acids having the sequences GSGEGSEGEGGGEGSEGEGSGEGGEGEGSG (SEQ ID NO: 82), TGSGEGSEGEGGGEGSEGEGSGEGGEGEGSGT (SEQ ID NO: 83), GATPPETGAETESPGETTGGSAESEPPGEG (SEQ ID NO: 84), or GSAAPTAGTTPSASPAPPTGGS-SAAGSPST (SEQ ID NO: 85). In some embodiments, the AF1 and AF2 are linked together by a short linker of hydrophilic amino acids having 3, 4, 5, 6, or 7 amino acids. In some embodiments, the short linker sequences are identified herein as the sequences SGGGGS (SEQ ID NO: 86), GGGGS (SEQ ID NO: 87), GGSGGS (SEQ ID NO: 88), GGS, or GSP. In some embodiments, the disclosure provides compositions comprising a single chain diabody in which after folding, the first domain (VL or VH) is paired with the last domain (VH or VL) to form one scFv and the two domains in the middle are paired to form the other scFv in which the first and second domains, as well as the third and last domains, are fused together by one of the foregoing short linkers and the second and the third variable domains are fused by one of the foregoing relatively long linkers. In some embodiments, the selection of the short linker and relatively long linker is to prevent the incorrect pairing of adjacent variable domains, thereby facilitating the formation of a single chain configuration comprising the VL and VH of the first antigen binding fragment and the second antigen binding fragment.

In some embodiments, the present disclosure provides an antigen binding fragment (e.g., AF1 or AF2) that binds to EGFR that has enhanced stability compared to EGFR binding antibodies or antigen binding fragments known in the art. In some embodiments, an EGFR antigen binding fragment of the disclosure is designed to confer a higher degree of stability on the chimeric bispecific antigen binding fragment compositions into which they are integrated, leading to improved expression and recovery of the fusion protein, increased shelf-life and enhanced stability when administered to a subject. In some embodiments, an anti-EGFR AF of the present disclosure has a higher degree of thermal stability compared to certain EGFR-binding antibodies and antigen binding fragments known in the art. In some embodiments, an anti-EGFR AF of the present disclosure has a higher degree of thermal stability compared to an antigen binding fragment comprising the VH and VL of panitumumab. In some embodiments, an anti-EGFR AF of the present disclosure has a higher degree of thermal stability compared to EGFR.2 as disclosed in PCT International Patent Application Publication No. WO/2020/264208. In some embodiments, the anti-EGFR AF of the present disclosure is less immunogenic in a human compared to certain EGFR-binding antibodies and antigen binding fragments known in the art. In some embodiments, an anti-EGFR AF of the present disclosure is less immunogenic than antigen binding fragment comprising the VH and VL of panitumumab. In some embodiments, an anti-EGFR AF of the present disclosure is less immunogenic than EGFR.2 as disclosed in PCT International Patent Application Publication No. WO/2020/264208. In some embodiments, the degree to which an AF is immunogenic is determined by an immunogenicity prediction method such as TEPITOPEpan (described in Zhang et al. PLoS One. 2012; 7 (2): e30483. doi: 10.1371/journal.pone.0030483, PMID: 22383964, the entire content of which is incorporated herein by reference) or NetMHCpan-4.1 and NetMHCIIpan-4.0 (each described in Reynisson et al., Nucleic Acids Res 2020; 48 (W1): W449-W454. doi: 10.1093/nar/gkaa379., PMID: 32406916, the entire content of which is hereby incorporated herein by reference). In some embodiments, the anti-EGFR AF utilized as components of the chimeric bispecific antigen binding fragment compositions into which they are integrated exhibit favorable pharmaceutical properties, including high thermostability and low aggregation propensity, resulting in improved expression and recovery during manufacturing and storage, as well promoting long serum half-life. Biophysical properties such as thermostability are often limited by the antibody variable domains, which differ greatly in their intrinsic properties. High thermal stability is often associated with high expression levels and other desired properties, including being less susceptible to aggregation (Buchanan A, et al. Engineering a therapeutic IgG molecule to address cysteinylation, aggregation and enhance thermal stability and expression. MAbs 2013; 5:255). In some embodiments, thermal stability is determined by measuring the "melting temperature" ($T_m$), which is defined as the temperature at which half of the molecules are denatured. The melting temperature of each heterodimer is indicative of its thermal stability. In vitro assays to determine Tm are known in the art, including methods described in the Examples, below. The melting point of the heterodimer may be measured using techniques such as differential scanning calorimetry (Chen et al (2003) Pharm Res 20:1952-60; Ghirlando et al (1999) Immunol Lett 68:47-52). Alternatively, the thermal stability of the heterodimer may be measured using circular dichroism (Murray et al. (2002) J. Chromatogr Sci 40:343-9), or as described in the Examples, below.

In some embodiments of the polypeptides of this disclosure, the antigen binding fragment (e.g., AF1 or AF2) can exhibit a higher thermal stability than an anti-EGFR binding fragment comprising a VH of SEQ ID NO: 450 and a VL of SEQ ID NO: 451 (see Table 5f), as evidenced in an in vitro assay by a higher melting temperature ($T_m$) of the first antigen binding fragment relative to that of the anti-EGFR binding fragment; or upon incorporating the first antigen binding fragment into a test bispecific antigen binding domain, a higher Tm of the test bispecific antigen binding domain relative to that of a control bispecific antigen binding domain, wherein the test bispecific antigen binding domain comprises the first antigen binding fragment and a reference antigen binding fragment that binds to an antigen other than EGFR; and wherein the control bispecific antigen binding domain consists of the anti-EGFR binding fragment comprising a VH of SEQ ID NO: 450 and a VL of SEQ ID NO: 451 (see Table 5f) and the reference antigen binding fragment. In some embodiments, the melting temperature ($T_m$) of the first antigen binding fragment can be at least 2° C. greater, or at least 3° C. greater, or at least 4° C. greater, or at least 5° C. greater than the Tm of the anti-EGFR binding fragment comprising a VH of SEQ ID NO: 450 and a VL of SEQ ID NO: 451 (see Table 5f). In some embodiments, the melting temperature ($T_m$) of the first antigen binding fragment can be 2° C. to 15° C. greater, or 3° C. to 15° C. greater, or 4° C. to 15° C. greater, or 5° C. to 15° C. greater than the Tm of the anti-EGFR binding fragment comprising a VH of SEQ ID NO: 450 and a VL of SEQ ID NO: 451 (see Table 5f).

In some embodiments, the polypeptides of any of the subject composition embodiments described herein comprise an antigen binding fragment (AF) that specifically bind human EGFR. The antigen binding fragment (AF) can specifically bind human EGFR. In some embodiments, the antigen binding fragment (AF) can specifically bind human EGFR with a binding affinity ($K_D$) constant between about 10 nM and about 400 nM, or between about 50 nM and about 350 nM, or between about 100 nM and 300 nM, as determined in an in vitro antigen-binding assay comprising a human EGFR antigen. In some embodiments, the polypeptides of any of the subject composition embodiments described herein comprise an antigen binding fragment (AF) that specifically binds human EGFR with a binding affinity ($k_D$)) weaker than about 10 nM, or about 50 nM, or about 100 nM, or about 150 nM, or about 200 nM, or about 250 nM, or about 300 nM, or about 350 nM, or weaker than about 400 nM as determined in an in vitro antigen-binding assay. For clarity, an antigen binding fragment (AF) with a $k_D$ of 400 binds its ligand more weakly than one with a $k_D$ of 10 nM. In some embodiments, the polypeptides of any of the subject composition embodiments described herein comprise an antigen binding fragment (AF) that specifically binds human EGFR with at least 2-fold, 3-fold, 4-fold, 5-fold, 6-fold, 7-fold, 8-fold, 9-fold, or at least 10-fold weaker binding affinity than an antigen binding fragment consisting of an amino acid sequence of Table 5f, as determined by the respective binding affinities ($K_D$) in an in vitro antigen-binding assay.

In some embodiments, the present disclosure provides bispecific polypeptides comprising an antigen binding fragment (AF) that exhibits a binding affinity to EGFR (anti-EGFR AF) that is at least 2-fold, 3-fold, 4-fold, 5-fold, 6-fold, 7-fold, 8-fold, 9-fold, 10-fold, 20-fold, 50-fold, 100-fold, or at least 1000-fold at weaker relative to that of an anti-EGFR AF embodiments described herein that are incorporated into the subject polypeptides, as determined by the respective binding affinities ($k_D$) in an in vitro antigen-binding assay.

The binding affinity of the subject compositions for the target ligands can be assayed, e.g., using binding or competitive binding assays, such as Biacore assays with chip-bound receptors or binding proteins or ELISA assays, as described in U.S. Pat. No. 5,534,617, assays described in the Examples herein, radio-receptor assays, or other assays known in the art. The binding affinity constant can then be determined using standard methods, such as Scatchard analysis, as described by van Zoelen, et al., Trends Pharmacol Sciences (1998) 19) 12): 487, or other methods known in the art.

In some embodiments, the present disclosure provides an antigen binding fragment (AF) that binds to EGFR (anti-EGFR AF) and is incorporated into a chimeric, bispecific polypeptide composition that is designed to have an isoelectric point (pI) that confers enhanced stability on the composition compared to corresponding compositions comprising EGFR binding antibodies or antigen binding fragments known in the art. In some embodiments, the polypeptides of any of the subject composition embodiments described herein comprise AF that bind to EGFR (anti-EGFR AF) wherein the anti-EGFR AF exhibits a pI that is between 6.0 and 6.6, inclusive. In some embodiments, the polypeptides of any of the subject composition embodiments described herein comprise AF that bind to EGFR (anti-EGFR AF) wherein the anti-EGFR AF exhibits a pI that is at least 0.1, 0.2, 0.3, 0.4, 0.5, 0.6, 0.7, 0.8, 0.9, or 1.0 pH unit lower than the pI of a reference antigen binding fragment. In some embodiments, the polypeptides of any of the subject composition embodiments described herein comprise an AF that binds to EGFR (anti-EGFR AF) fused to another AF that binds to a CD3 antigen (anti-CD3 AF) wherein the anti-EGFR AF exhibits a pI that is within at least 0.1, 0.2, 0.3, 0.4, 0.5, 0.6, 0.7, 0.8, 0.9, 1.0, 1.1, 1.2, 1.3, 1.4, or 1.5 pH units of the pI of the AF that binds CD3 antigen or an epitope thereof. In some embodiments, the polypeptides of any of the subject composition embodiments described herein comprise an AF that binds to EGFR (anti-EGFR AF) fused to an AF that binds to a CD3 antigen (anti-CD3 AF) wherein the AF exhibits a pI that is within at least about 0.1 to about 1.5, or at least about 0.3 to about 1.2, or at least about 0.5 to about 1.0, or at least about 0.7 to about 0.9 pH units of the pI of the anti-EGFR AF. It is specifically intended that by such design wherein the pI of the two antigen binding fragments are within such ranges, the resulting fused antigen binding fragments will confer a higher degree of stability on the chimeric bispecific antigen binding fragment compositions into which they are integrated, leading to improved expression and enhanced recovery of the fusion protein in soluble, non-aggregated form, increased shelf-life of the formulated chimeric bispecific polypeptide compositions, and enhanced stability when the composition is administered to a subject. In some embodiments, having the two AFs (the anti-EGFR AF and the anti-CD3 AF) within a relatively narrow pI range of may allow for the selection of a buffer or other solution in which both the AFs (anti-EGFR AF and anti-CD3 AF) are stable, thereby promoting overall stability of the composition. In some embodiments, the antigen binding fragment (AF) can exhibit an isoelectric point (pI) that is less than or equal to 6.6. In some embodiments, the antigen binding fragment (AF) can exhibit an isoelectric point (pI) that is between 6.0 and 6.6, inclusive.

Unless otherwise specified, numbering of amino acid residues in the variable domain of antibody domain, antigen binding domain, or fragment thereof described herein is according to the Kabat numbering scheme. The Kabat numbering for EGFR.2 VH (SEQ ID NO: 450) and VL (SEQ ID NO: 451) is provided below.

TABLE 5g

Kabat numbering of EGFR.2 VH (SEQ ID NO: 450) and VL (SEQ ID NO: 451)

| VH residue | VH Position relative to SEQ ID NO: 450 | VH Position according to Kabat numbering | VL residue | VL Position relative to SEQ ID NO: 451 | VL Position according to Kabat numbering |
|---|---|---|---|---|---|
| Q | 1 | 1 | D | 1 | 1 |
| V | 2 | 2 | I | 2 | 2 |
| Q | 3 | 3 | Q | 3 | 3 |
| L | 4 | 4 | M | 4 | 4 |
| Q | 5 | 5 | T | 5 | 5 |
| E | 6 | 6 | Q | 6 | 6 |
| S | 7 | 7 | S | 7 | 7 |
| G | 8 | 8 | P | 8 | 8 |
| P | 9 | 9 | S | 9 | 9 |
| G | 10 | 10 | S | 10 | 10 |
| L | 11 | 11 | L | 11 | 11 |
| V | 12 | 12 | S | 12 | 12 |
| K | 13 | 13 | A | 13 | 13 |
| P | 14 | 14 | S | 14 | 14 |
| S | 15 | 15 | V | 15 | 15 |
| E | 16 | 16 | G | 16 | 16 |
| T | 17 | 17 | D | 17 | 17 |
| L | 18 | 18 | R | 18 | 18 |
| S | 19 | 19 | V | 19 | 19 |
| L | 20 | 20 | T | 20 | 20 |
| T | 21 | 21 | I | 21 | 21 |
| C | 22 | 22 | T | 22 | 22 |
| T | 23 | 23 | C | 23 | 23 |
| V | 24 | 24 | Q | 24 | 24 |
| S | 25 | 25 | A | 25 | 25 |
| G | 26 | 26 | S | 26 | 26 |
| G | 27 | 27 | Q | 27 | 27 |
| S | 28 | 28 | D | 28 | 28 |
| V | 29 | 29 | I | 29 | 29 |
| S | 30 | 30 | S | 30 | 30 |
| S | 31 | 31 | N | 31 | 31 |
| G | 32 | 32 | Y | 32 | 32 |
| D | 33 | 33 | L | 33 | 33 |
| Y | 34 | 34 | N | 34 | 34 |
| Y | 35 | 35 | W | 35 | 35 |
| W | 36 | 35A | Y | 36 | 36 |
| T | 37 | 35B | Q | 37 | 37 |
| W | 38 | 36 | Q | 38 | 38 |
| I | 39 | 37 | K | 39 | 39 |
| R | 40 | 38 | P | 40 | 40 |
| Q | 41 | 39 | G | 41 | 41 |
| S | 42 | 40 | K | 42 | 42 |
| P | 43 | 41 | A | 43 | 43 |
| G | 44 | 42 | P | 44 | 44 |
| K | 45 | 43 | K | 45 | 45 |
| G | 46 | 44 | L | 46 | 46 |
| L | 47 | 45 | L | 47 | 47 |

TABLE 5g-continued

Kabat numbering of EGFR.2 VH (SEQ ID NO: 450) and VL (SEQ ID NO: 451)

| VH residue | VH Position relative to SEQ ID NO: 450 | VH Position according to Kabat numbering | VL residue | VL Position relative to SEQ ID NO: 451 | VL Position according to Kabat numbering |
|---|---|---|---|---|---|
| E | 48 | 46 | I | 48 | 48 |
| W | 49 | 47 | Y | 49 | 49 |
| I | 50 | 48 | D | 50 | 50 |
| G | 51 | 49 | A | 51 | 51 |
| H | 52 | 50 | S | 52 | 52 |
| I | 53 | 51 | N | 53 | 53 |
| Y | 54 | 52 | L | 54 | 54 |
| Y | 55 | 53 | E | 55 | 55 |
| S | 56 | 54 | T | 56 | 56 |
| G | 57 | 55 | G | 57 | 57 |
| N | 58 | 56 | V | 58 | 58 |
| T | 59 | 57 | P | 59 | 59 |
| N | 60 | 58 | S | 60 | 60 |
| Y | 61 | 59 | R | 61 | 61 |
| N | 62 | 60 | F | 62 | 62 |
| P | 63 | 61 | S | 63 | 63 |
| S | 64 | 62 | G | 64 | 64 |
| L | 65 | 63 | S | 65 | 65 |
| K | 66 | 64 | G | 66 | 66 |
| S | 67 | 65 | S | 67 | 67 |
| R | 68 | 66 | G | 68 | 68 |
| L | 69 | 67 | T | 69 | 69 |
| T | 70 | 68 | D | 70 | 70 |
| I | 71 | 69 | F | 71 | 71 |
| S | 72 | 70 | T | 72 | 72 |
| I | 73 | 71 | F | 73 | 73 |
| D | 74 | 72 | T | 74 | 74 |
| T | 75 | 73 | I | 75 | 75 |
| S | 76 | 74 | S | 76 | 76 |
| K | 77 | 75 | S | 77 | 77 |
| T | 78 | 76 | L | 78 | 78 |
| Q | 79 | 77 | Q | 79 | 79 |
| F | 80 | 78 | P | 80 | 80 |
| S | 81 | 79 | E | 81 | 81 |
| L | 82 | 80 | D | 82 | 82 |
| K | 83 | 81 | I | 83 | 83 |
| L | 84 | 82 | A | 84 | 84 |
| S | 85 | 82A | T | 85 | 85 |
| S | 86 | 82B | Y | 86 | 86 |
| V | 87 | 82C | F | 87 | 87 |
| T | 88 | 83 | C | 88 | 88 |
| A | 89 | 84 | Q | 89 | 89 |
| A | 90 | 85 | H | 90 | 90 |
| D | 91 | 86 | F | 91 | 91 |
| T | 92 | 87 | D | 92 | 92 |
| A | 93 | 88 | H | 93 | 93 |
| I | 94 | 89 | L | 94 | 94 |
| Y | 95 | 90 | P | 95 | 95 |
| Y | 96 | 91 | L | 96 | 96 |
| C | 97 | 92 | A | 97 | 97 |
| V | 98 | 93 | F | 98 | 98 |
| R | 99 | 94 | G | 99 | 99 |
| D | 100 | 95 | G | 100 | 100 |
| R | 101 | 96 | G | 101 | 101 |
| V | 102 | 97 | T | 102 | 102 |
| T | 103 | 98 | K | 103 | 103 |
| G | 104 | 99 | V | 104 | 104 |
| A | 105 | 100 | E | 105 | 105 |
| F | 106 | 100A | I | 106 | 106 |
| D | 107 | 101 | K | 107 | 107 |
| I | 108 | 102 | | | |
| W | 109 | 103 | | | |
| G | 110 | 104 | | | |
| Q | 111 | 105 | | | |
| G | 112 | 106 | | | |
| T | 113 | 107 | | | |
| M | 114 | 108 | | | |
| V | 115 | 109 | | | |
| T | 116 | 110 | | | |
| V | 117 | 111 | | | |

TABLE 5g-continued

| | Kabat numbering of EGFR.2 VH (SEQ ID NO: 450) and VL (SEQ ID NO: 451) | | | | |
|---|---|---|---|---|---|
| VH residue | VH Position relative to SEQ ID NO: 450 | VH Position according to Kabat numbering | VL residue | VL Position relative to SEQ ID NO: 451 | VL Position according to Kabat numbering |
| S | 118 | 112 | | | |
| S | 119 | 113 | | | |

Linkers and Spacers Between Antibody Regions in Bispecific Antibodies

In some embodiments of the polypeptides of this disclosure, a pair of the light chain variable region (VL) and the heavy chain variable region (VH) of an antigen binding fragment can be linked by a linker, or a long linker (e.g., of hydrophilic amino acids). In some embodiments, a first antigen binding fragment (AF1) (e.g., an scFv domain, such as an anti-EGFR scFv domain) and a second antigen binding fragment (AF2) (e.g., an scFv, such as an anti-CD3 scFv) are linked by linker, or a long linker (e.g., of hydrophilic amino acids). In some embodiments, a linker linking the light chain variable region (VL) and the heavy chain variable region (VH) of an antigen binding fragment (e.g., a first antigen binding fragment (AF1) and/or a second antigen binding fragment (AF2)), can (each independently) comprise an amino acid sequence having at least 85%, 90%, 91%, 92%, 93%, 94%, 95%, 96%, 97%, 98%, 99% or 100% sequence identity to a sequence set forth in Table A. In some embodiments, a linker linking the light chain variable region (VL) and the heavy chain variable region (VH) of an antigen binding fragment (e.g., a first antigen binding fragment (AF1) and/or a second antigen binding fragment (AF2)), can (each independently) comprise an amino acid sequence identical to a sequence set forth in Table A. In some embodiments of the polypeptides of this disclosure, two antigen binding fragments (e.g., a first and a second antigen binding fragments) can be fused together by a peptide linker, or a short linker. In some embodiments, the peptide linker linking two antigen binding fragments (e.g., a first and a second antigen binding fragments), can comprise an amino acid sequence having at least 85%, 90%, 91%, 92%, 93%, 94%, 95%, 96%, 97%, 98%, 99% or 100% sequence identity to a sequence set forth in Table B. In some embodiments, the peptide linker linking two antigen binding fragments (e.g., a first and a second antigen binding fragments), can comprise an amino acid sequence identical to a sequence set forth in Table B. In some cases, the first antigen binding fragment is a single-chain variable fragment (scFv). In some cases, the second antigen binding fragment is a single-chain variable fragment (scFv). The two single-chain variable fragments of the first and second antigen binding fragments can be linked together by the peptide linker. In some embodiments of the polypeptides of this disclosure, the linker used to link the scFv of the first antigen binding fragment (e.g., an anti-EGFR scFv) and the linker used to link the VL and VH of the second antigen binding fragment (e.g., an anti-CD3 scFv) can be GGGGSGGGS (SEQ ID NO: 125) of Table A. In other embodiments, the linker used to link the VL and VH of an antigen binding fragment (e.g., an anti-CD3 scFv) can be SESATPESGPGTSPGATPESGPGTSESATP (SEQ ID NO: 81). In some embodiments, the disclosure provides polypeptides comprising a single chain diabody in which after folding, the first domain (VL or VH) is paired with the last domain (VH or VL) to form one scFv and the two domains in the middle are paired to form the other scFv in which the first and second domains, as well as the third and last domains, are fused together by a short linker of hydrophilic amino acids identified herein by the sequences set forth in Table B and the second and the third variable domains are fused by a long linker identified in Table A. In some embodiments, the selection of the short linker and long linker is to prevent the incorrect pairing of adjacent variable domains, thereby facilitating the formation of the single chain configuration comprising the VL and VH of the first binding moiety and the second binding moiety.

TABLE A

| | Intramolecular Long Linkers | | |
|---|---|---|---|
| Linker # | Name | SEQ ID | Amino Acid Sequence |
| L1 | (G4S)3 | 112 | GGGGSGGGGSGGGGS |
| L2 | MT110_18 | 113 | GEGTSTGSGGSGGSGGAD |
| L3 | MT103_18 | 114 | VEGGSGGSGGSGGSGGVD |
| L4 | UCHT1_29 | 115 | RTSGPGDGGKGGPGKGPG GEGTKGTGPGG |
| L5 | Y30 | 116 | GSGEGSEGEGGGEGSEGE GSGEGGEGEGSG |
| L6 | Y32 | 117 | TGSGEGSEGEGGGEGSEG EGSGEGGEGEGSGT |
| L7 | G1_30_3 | 118 | GATPPETGAETESPGETT GGSAESEPPGEG |
| L8 | G9_30_1 | 119 | GSAAPTAGTTPSASPAPP TGGSSAAGSPST |
| L9 | Y30_modified | 120 | GEGGESGGSEGEGSGEGE GGSGGEGESEGG |
| L10 | G1_30_1 | 121 | STETSPSTPTESPEAGSG SGSPESPSGTEA |
| L11 | G1_30_2 | 122 | PTGTTGEPSGEGSEPEGS APTSSTSEATPS |
| L12 | G1_30_4 | 123 | SESESEGEAPTGPGASTT PEPSESPTPETS |
| L13 | UCHT1_modified | 124 | PEGGESGEGTGPGTGGEP EGEGGPGGEGGT |

TABLE B

| | Intermolecular Short Linkers | |
|---|---|---|
| Name | | Amino Acid Sequence |
| S-1 | | GGGGSGGGS (SEQ ID NO: 125) |
| S-2 | | SGGGGS (SEQ ID NO: 86) |
| S-3 | | GGGGS (SEQ ID NO: 87) |
| S-4 | | GGS |
| S-5 | | GSP |

Spacers & TCE Release Segments

Included herein are fusion proteins comprising TCE components that either becomes biologically active or have an increase in biological activity upon release from an ELNN by cleavage of an optional cleavage sequence incorporated within optional spacer sequences into the fusion protein, e.g., as described herein.

In some embodiments, the spacer may be provided to enhance expression of the fusion protein from a host cell and/or to decrease steric hindrance such that the TCE component may assume its desired tertiary structure and/or interact appropriately with its target molecule. For spacers and methods of identifying desirable spacers, see, for example, George, et al. (2003) Protein Engineering 15:871-879, specifically incorporated by reference herein. In some embodiments, the spacer comprises one or more peptide sequences that are between 1 to 50 amino acid residues in length, or about 1 to 25 residues, or about 1 to 10 residues in length. Spacer sequences, exclusive of cleavage sites, can comprise any of the 20 natural L amino acids, and will preferably comprise hydrophilic amino acids that are sterically unhindered that can include, but not be limited to, glycine (G), alanine (A), serine(S), threonine (T), glutamate (E) or proline (P). In some embodiments, the spacer can be a polyglycine or polyalanine, or predominately a mixture of combinations of glycine and alanine residues. In some embodiments, the spacer polypeptide exclusive of a cleavage sequence is substantially devoid of secondary structure. In some embodiments, one or both spacer sequences in a paTCE fusion protein composition may each further contain a cleavage sequence, which may be identical or may be different, wherein the cleavage sequence may be acted on by a protease to release the TCE from the fusion protein.

TABLE C

| Exemplary Spacers between a Release Segment and a Bispecific Antibody Domain | |
| --- | --- |
| Amino Acid Sequence | SEQ ID NO: |
| STEPS | 89 |
| SATPESGPGT | 90 |
| ATSGSETPGT | 91 |
| GTAEAASASG | 92 |
| STEPSEGSAPGTS | 93 |
| SGPGTS | 94 |
| GTSTEPS | 95 |
| GTSESATPES | 96 |
| GTATPESGPG | 97 |

In some embodiments of the polypeptides of this disclosure, a release segment (RS) (e.g., a first release segment (RS1), a second release segment (RS2), etc.) can be fused to a bispecific antibody domain (BsAb) by a spacer. In some embodiments, a spacer can (each independently) comprise at least 4 types of amino acids that are glycine (G), alanine (A), serine(S), threonine (T), glutamate (E) or proline (P). In some embodiments, the peptides of this disclosure can comprise a first release segment fused to the bispecific antibody domain via a first spacer and a second release segment fused to the bispecific antibody domain via a second spacer. In some embodiments, a spacer (e.g., a first spacer, a second spacer, etc.) can (each independently) comprise an amino acid sequence having at least (about) 80%, at least (about) 90%, or 100% sequence identity to a sequence set forth in Table C. In some embodiments, the spacer (e.g., the first spacer, the second spacer, etc.) can (each independently) comprise an amino acid sequence identical to a sequence set forth in Table C.

In some embodiments, the incorporation of the cleavage sequence into a fusion protein is designed to permit release of a TCE that becomes active or more active upon its release from one or more ELNNs. In some embodiments, the cleavage sequences are located sufficiently close to the TCE sequences, generally within 18, or within 12, or within 6, or within 2 amino acids of the TCE sequence terminus, such that any remaining residues attached to the TCE after cleavage do not appreciably interfere with the activity (e.g., such as binding to a receptor) of the TCE yet provide sufficient access to the protease to be able to effect cleavage of the cleavage sequence. In some embodiments, the cleavage site is a sequence that can be cleaved by a protease endogenous to the mammalian subject such that a paTCE can be cleaved after administration to a subject. In such cases, the paTCE can serve as a circulating depot for the TCE. Examples of cleavage sites contemplated herein include, but are not limited to, a polypeptide sequence cleavable by a mammalian endogenous protease listed in Table 6.

In some embodiments, a paTCE fusion protein comprises spacer sequences that comprise one or more cleavage sequences configured to release the TCE from the fusion protein when acted on by a protease. In some embodiments, a spacer sequence does not comprise a cleavage sequence. In some embodiments, the one or more cleavage sequences can be a sequence having at least about 80% (e.g., at least about 85%, at least about 90%, at least about 95%, at least about 96%, at least about 97%, at least about 98%, at least about 99%, or 100%) sequence identify to a sequence from Table 7a or 7b.

In some embodiments, the disclosure provides TCE release segment polypeptides (or release segments (RSs)) that are substrates for one or more mammalian proteases associated with or produced by disease tissues or cells found in proximity to disease tissues. Such proteases can include, but not be limited to the classes of proteases such as metalloproteinases, cysteine proteases, aspartate proteases, and serine proteases, including, but not limited to, the proteases of Table 6. The RSs are useful for, amongst other things, incorporation into the subject recombinant polypeptides, conferring an inactive format that can be activated by the cleavage of the RSs by mammalian proteases. As described herein, the RSs are incorporated into the subject recombinant polypeptide compositions, linking the incorporated binding moieties to the ELNN (exemplary configurations of which are described herein) such that upon cleavage of the RSs by action of the one or more proteases for which the RSs are substrates, the binding moieties and ELNN are released from the composition and the binding moieties, no longer shielded by the ELNN, regain their full potential to bind their ligands.

TABLE 6

| Proteases of Target Tissues | |
| --- | --- |
| Class of Proteases | Protease |
| Metalloproteinases | Meprin |
| | Neprilysin (CD10) |
| | PSMA |
| | BMP-1 |
| | A disintegrin and metalloproteinases (ADAMs) |
| | ADAM8 |
| | ADAM9 |
| | ADAM10 |
| | ADAM12 |
| | ADAM15 |
| | ADAM17 (TACE) |
| | ADAM19 |
| | ADAM28 (MDC-L) |
| | ADAM with thrombospondin motifs (ADAMTS) |
| | ADAMTS1 |
| | ADAMTS4 |
| | ADAMTS5 |
| | Matrix Metalloproteinases (MMPs) |
| | MMP-1 (Collagenase 1) |
| | MMP-2 (Gelatinase A) |
| | MMP-3 (m1) |
| | MMP-7 (Matrilysin 1) |
| | MMP-8 (Collagenase 2) |
| | MMP-9 (Gelatinase B) |
| | MMP-10 (Stromelysin 2) |
| | MMP-11(Stromelysin 3) |
| | MMP-12 (Macrophage elastase) |
| | MMP-13 (Collagenase 3) |
| | MMP-14 (MT1-MMP) |
| | MMP-15 (MT2-MMP) |
| | MMP-19 |
| | MMP-23 (CA-MMP) |
| | MMP-24 (MT5-MMP) |
| | MMP-26 (Matrilysin 2) |
| | MMP-27 (CMMP) |
| Cysteine Proteases | Legumain |
| | Cysteine cathepsins |
| | Cathepsin B |
| | Cathepsin C |
| | Cathepsin K |
| | Cathepsin L |
| | Cathepsin S |
| | Cathepsin X |
| Aspartate Proteases | Cathepsin D |
| | Cathepsin E |
| | Secretase |
| Serine Proteases | Urokinase (uPA) |
| | Tissue-type plasminogen activator (tPA) |
| | Plasmin |
| | Thrombin |
| | Prostate-specific antigen (PSA, KLK3) |
| | Human neutrophil elastase (HNE) |
| | Elastase |
| | Tryptase |
| | Type II transmembrane serine proteases (TTSPs) |
| | DESC1 |
| | Hepsin (HPN) |
| | Matriptase |
| | Matriptase-2 |
| | TMPRSS2 |
| | TMPRSS3 |
| | TMPRSS4 (CAP2) |
| | Fibroblast Activation Protein (FAP) |
| | kallikrein-related peptidase (KLK family) |
| | KLK4 |
| | KLK5 |
| | KLK6 |
| | KLK7 |
| | KLK8 |
| | KLK10 |
| | KLK11 |
| | KLK13 |
| | KLK14 |

In some embodiments, the disclosure provides activatable recombinant polypeptides comprising a first release segment (RS1) sequence having at least 88%, or at least 94%, or 100% sequence identity, when optimally aligned, to a sequence identified in Table 7a, wherein the RS1 is a substrate for one or more mammalian proteases. In some embodiments, the RS is further engineered to remove a legumain cleavage site. In some embodiments, the disclosure provides activatable recombinant polypeptides comprising a RS1 and a second release segment (RS2) sequence, each having at least 88%, or at least 94%, or 100% sequence identity, when optimally aligned, to a sequence identified herein by the sequences set forth in Table 7a, wherein the RS1 and the RS2 each are a substrate for one or more mammalian proteases. In some embodiments, the RS1 and RS2 each do not serve as substrates for legumain.

In some embodiments, disclosure provides activatable recombinant polypeptides comprising a first RS (RS1) sequence having at least 90%, at least 93%, at least 97%, or 100% identity, when optimally aligned, to a sequence identified in Table 7b, wherein the RS1 is a substrate for one or more mammalian proteases. In some embodiments, the disclosure provides activatable recombinant polypeptides comprising a RS1 and a second release segment (RS2) sequence, each having at least 88%, or at least 94%, or 100% sequence identity, when optimally aligned, to a sequence identified herein by the sequences set forth in Table 7b, wherein the RS1 and the RS2 are each a substrate for one or more mammalian proteases (e.g., at one, two, or three cleavage sites within each release segment sequence). In some embodiments of activatable recombinant polypeptides comprising RS1 and RS2, the two release segments can be identical. In some embodiments of activatable recombinant polypeptides comprising RS1 and RS2, the two release segments can be different.

The present disclosure contemplates release segments that are substrates for one, two or three different classes of proteases that are metalloproteinases, cysteine proteases, aspartate proteases, or serine proteases, including the proteases of Table 6. In some embodiments, a paTCE comprises RSs (e.g., RS1 and RS2) that serve as substrates for one or more proteases found in close association with or are co-localized with tumors or cancer cells, and upon cleavage of the RSs, the binding moieties that are otherwise shielded by ELNNs of the paTCE (and thus have a lower binding affinity for their respective ligands) are released from the ELNNs and regain their full potential to bind target and effector cell ligands. In some embodiments, a paTCE comprises RSs (e.g., RS1 and RS2), that each comprise an amino acid sequence that is a substrate for one or more cellular proteases located within a targeted cell, including but not limited to a protease of Table 6. In some embodiments, RSs are substrates for two or three classes of proteases that cleave different portions of each RS. In some embodiments, each RS that is a substrate for two, three, or more classes of proteases has two, three, or more distinct cleavage sites, but cleavage by a single protease nevertheless results in the release of the binding moieties from an ELNN.

In some embodiments, an RS of the disclosure for incorporation into a fusion protein (such as a paTCE) is a substrate for one or more proteases including but not limited to meprin, neprilysin (CD10), PSMA. BMP-1, A disintegrin and metalloproteinases (ADAMs), ADAM8, ADAM9, ADAM10, ADAM12. ADAM15, ADAM17 (TACE), ADAM19, ADAM28 (MDC-L), ADAM with thrombospondin motifs (ADAMTS), ADAMTS1. ADAMTS4, ADAMTS5, MMP-1 (collagenase 1), matrix metalloproteinase-1 (MMP-1), matrix metalloproteinase-2 (MMP-2, gelatinase A), matrix metalloproteinase-3 (MMP-3, stromelysin 1), matrix metalloproteinase-7 (MMP-7, Matrilysin 1), matrix metalloproteinase-8 (MMP-8, collagenase 2), matrix metalloproteinase-9 (MMP-9, gelatinase B), matrix metalloproteinase-10 (MMP-10, stromelysin 2), matrix metalloproteinase-11 (MMP-11, stromelysin 3), matrix metalloproteinase-12 (MMP-12, macrophage clastase), matrix metalloproteinase-13 (MMP-13, collagenase 3), matrix metalloproteinase-14 (MMP-14, MT1-MMP), matrix metalloproteinase-15 (MMP-15, MT2-MMP), matrix metalloproteinase-19 (MMP-19), matrix metalloproteinase-23 (MMP-23, CA-MMP), matrix metalloproteinasc-24 (MMP-24, MT5-MMP), matrix metalloproteinasc-26 (MMP-26, matrilysin 2), matrix metalloproteinase-27 (MMP-27, CMMP), legumain, cathepsin B, cathepsin C, cathepsin K, cathepsin L, cathepsin S, cathepsin X, cathepsin D, cathepsin E, secretase, urokinase (uPA), tissue-type plasminogen activator (tPA), plasmin, thrombin, prostate-specific antigen (PSA, KLK3), human neutrophil elastase (HNE), elastase, tryptase, Type II transmembrane serine proteases (TTSPs), DESC1, hepsin (HPN), matriptase, matriptase-2, TMPRSS2, TMPRSS3, TMPRSS4 (CAP2), fibroblast activation protein (FAP), kallikrein-related peptidase (KLK family), KLK4, KLK5, KLK6, KLK7, KLK8, KLK10, KLK11, KLK13, and KLK14. In some embodiments, the RS is a substrate for ADAM17. In some embodiments, the RS is a substrate for BMP-1. In some embodiments, the RS is a substrate for cathepsin. In some embodiments, the RS is a substrate for HtrA1. In some embodiments, the RS is a substrate for legumain. In some embodiments, the RS is a substrate for MMP-1. In some embodiments, the RS is a substrate for MMP-2. In some embodiments, the RS is a substrate for MMP-7. In some embodiments, the RS is a substrate for MMP-9. In some embodiments, the RS is a substrate for MMP-11. In some embodiments, the RS is a substrate for MMP-14. In some embodiments, the RS is a substrate for uPA. In some embodiments, the RS is a substrate for matriptase. In some embodiments, the RS is a substrate for MT-SP1. In some embodiments, the RS is a substrate for neutrophil elastase. In some embodiments, the RS is a substrate for thrombin. In some embodiments RS is a substrate for TMPRSS3. In some embodiments, the RS is a substrate for TMPRSS4. In some embodiments, the RS of the subject recombinant polypeptide compositions is a substrate for at least two proteases including but not limited to legumain, MMP-1, MMP-2, MMP-7, MMP-9, MMP-11, MMP-14, uPA, and matriptase. In some embodiments, the RS of the subject recombinant polypeptide compositions is a substrate for legumain, MMP-1, MMP-2, MMP-7, MMP-9, MMP-11, MMP-14, uPA, and matriptase. In specific embodiments, the RS of the subject recombinant polypeptide compositions is not a substrate for legumain. In some embodiments, the RS of the subject recombinant polypeptide compositions is a substrate for uPA, matriptase (also known as MT-SP1 and ST14), MMP2, MMP7, MMP9, and MMP14. In some embodiments, the RS of the subject recombinant polypeptide compositions is substrate for uPA, matriptase, MMP2, MMP7, MMP9, and MMP14 but not legumain.

TABLE 7a

TCE Release Segment Sequences.

| Name | Amino Acid Sequence | SEQ ID NO |
|---|---|---|
| RSR-1517 | EAGRSANHEPLGLVAT | 7001 |
| BSRS-A1-1 | ASGRSTNAGPSGLAGP | 7002 |
| BSRS-A2-1 | ASGRSTNAGPQGLAGQ | 7003 |

TABLE 7a-continued

TCE Release Segment Sequences.

| Name | Amino Acid Sequence | SEQ ID NO |
|---|---|---|
| BSRS-A3-1 | ASGRSTNAGPPGLTGP | 7004 |
| VP-1 | ASSRGTNAGPAGLTGP | 7005 |
| RSR-1752 | ASSRTTNTGPSTLTGP | 7006 |
| RSR-1512 | AAGRSDNGTPLELVAP | 7007 |
| RSR-1517 | EAGRSANHEPLGLVAT | 7008 |
| VP-2 | ASGRGTNAGPAGLTGP | 7009 |
| RSR-1018 | LFGRNDNHEPLELGGG | 7010 |
| RSR-1053 | TAGRSDNLEPLGLVFG | 7011 |
| RSR-1059 | LDGRSDNFHPPELVAG | 7012 |
| RSR-1065 | LEGRSDNEEPENLVAG | 7013 |
| RSR-1167 | LKGRSDNNAPLALVAG | 7014 |
| RSR-1201 | VYSRGTNAGPHGLTGR | 7015 |
| RSR-1218 | ANSRGTNKGFAGLIGP | 7016 |
| RSR-1226 | ASSRLTNEAPAGLTIP | 7017 |
| RSR-1254 | DQSRGTNAGPEGLTDP | 7018 |
| RSR-1256 | ESSRGTNIGQGGLTGP | 7019 |
| RSR-1261 | SSSRGTNQDPAGLTIP | 7020 |
| RSR-1293 | ASSRGQNHSPMGLTGP | 7021 |
| RSR-1309 | AYSRGPNAGPAGLEGR | 7022 |
| RSR-1326 | ASERGNNAGPANLTGF | 7023 |
| RSR-1345 | ASHRGTNPKPAILTGP | 7024 |
| RSR-1354 | MSSRRTNANPAQLTGP | 7025 |
| RSR-1426 | GAGRTDNHEPLELGAA | 7026 |
| RSR-1478 | LAGRSENTAPLELTAG | 7027 |
| RSR-1479 | LEGRPDNHEPLALVAS | 7028 |
| RSR-1496 | LSGRSDNEEPLALPAG | 7029 |
| RSR-1508 | EAGRTDNHEPLELSAP | 7030 |
| RSR-1513 | EGGRSDNHGPLELVSG | 7031 |
| RSR-1516 | LSGRSDNEAPLELEAG | 7032 |
| RSR-1524 | LGGRADNHEPPELGAG | 7033 |
| RSR-1622 | PPSRGTNAEPAGLTGE | 7034 |
| RSR-1629 | ASTRGENAGPAGLEAP | 7035 |
| RSR-1664 | ESSRGTNGAPEGLTGP | 7036 |
| RSR-1667 | ASSRATNESPAGLTGE | 7037 |
| RSR-1709 | ASSRGENPPPGGLTGP | 7038 |
| RSR-1712 | AASRGTNTGPAELTGS | 7039 |

TABLE 7a-continued

| TCE Release Segment Sequences. | | |
| --- | --- | --- |
| Name | Amino Acid Sequence | SEQ ID NO |
| RSR-1727 | AGSRTTNAGPGGLEGP | 7040 |
| RSR-1754 | APSRGENAGPATLTGA | 7041 |
| RSR-1819 | ESGRAANTGPPTLTAP | 7042 |
| RSR-1832 | NPGRAANEGPPGLPGS | 7043 |
| RSR-1855 | ESSRAANLTPPELTGP | 7044 |
| RSR-1911 | ASGRAANETPPGLTGA | 7045 |
| RSR-1929 | NSGRGENLGAPGLTGT | 7046 |
| RSR-1951 | TTGRAANLTPAGLTGP | 7047 |
| RSR-2295 | EAGRSANHTPAGLTGP | 7048 |
| RSR-2298 | ESGRAANTTPAGLTGP | 7049 |
| RSR-2038 | TTGRATEAANLTPAGLTGP | 7050 |
| RSR-2072 | TTGRAEEAANLTPAGLTGP | 7051 |
| RSR-2089 | TTGRAGEAANLTPAGLTGP | 7052 |
| RSR-2302 | TTGRATEAANATPAGLTGP | 7053 |
| RSR-3047 | TTGRAGEAEGATSAGATGP | 7054 |
| RSR-3052 | TTGEAGEAANATSAGATGP | 7055 |
| RSR-3043 | TTGEAGEAAGLTPAGLTGP | 7056 |
| RSR-3041 | TTGAAGEAANATPAGLTGP | 7057 |
| RSR-3044 | TTGRAGEAAGLTPAGLTGP | 7058 |
| RSR-3057 | TTGRAGEAANATSAGATGP | 7059 |
| RSR-3058 | TTGEAGEAAGATSAGATGP | 7060 |
| RSR-2485 | ESGRAANTEPPELGAG | 7061 |
| RSR-2486 | ESGRAANTAPEGLTGP | 7062 |
| RSR-2488 | EPGRAANHEPSGLTEG | 7063 |
| RSR-2599 | ESGRAANHTGAPPGGLTGP | 7064 |
| RSR-2706 | TTGRTGEGANATPGGLTGP | 7065 |
| RSR-2707 | RTGRSGEAANETPEGLEGP | 7066 |
| RSR-2708 | RTGRTGESANETPAGLGGP | 7067 |
| RSR-2709 | STGRTGEPANETPAGLSGP | 7068 |
| RSR-2710 | TTGRAGEPANATPTGLSGP | 7069 |
| RSR-2711 | RTGRPGEGANATPTGLPGP | 7070 |
| RSR-2712 | RTGRGGEAANATPSGLGGP | 7071 |
| RSR-2713 | STGRSGESANATPGGLGGP | 7072 |
| RSR-2714 | RTGRTGEEANATPAGLPGP | 7073 |
| RSR-2715 | ATGRPGEPANTTPEGLEGP | 7074 |
| RSR-2716 | STGRSGEPANATPGGLTGP | 7075 |
| RSR-2717 | PTGRGGEGANTTPTGLPGP | 7076 |
| RSR-2718 | PTGRSGEGANATPSGLTGP | 7077 |

TABLE 7a-continued

| TCE Release Segment Sequences. | | |
| --- | --- | --- |
| Name | Amino Acid Sequence | SEQ ID NO |
| RSR-2719 | TTGRASEGANSTPAPLTEP | 7078 |
| RSR-2720 | TYGRAAEAANTTPAGLTAP | 7079 |
| RSR-2721 | TTGRATEGANATPAELTEP | 7080 |
| RSR-2722 | TVGRASEEANTTPASLTGP | 7081 |
| RSR-2723 | TTGRAPEAANATPAPLTGP | 7082 |
| RSR-2724 | TWGRATEPANATPAPLTSP | 7083 |
| RSR-2725 | TVGRASESANATPAELTSP | 7084 |
| RSR-2726 | TVGRAPEGANSTPAGLTGP | 7085 |
| RSR-2727 | TWGRATEAPNLEPATLTTP | 7086 |
| RSR-2728 | TTGRATEAPNLTPAPLTEP | 7087 |
| RSR-2729 | TQGRATEAPNLSPAALTSP | 7088 |
| RSR-2730 | TQGRAAEAPNLTPATLTAP | 7089 |
| RSR-2731 | TSGRAPEATNLAPAPLTGP | 7090 |
| RSR-2732 | TQGRAAEAANLTPAGLTEP | 7091 |
| RSR-2733 | TTGRAGSAPNLPPTGLTTP | 7092 |
| RSR-2734 | TTGRAGGAENLPPEGLTAP | 7093 |
| RSR-2735 | TTSRAGTATNLTPEGLTAP | 7094 |
| RSR-2736 | TTGRAGTATNLPPSGLTTP | 7095 |
| RSR-2737 | TTARAGEAENLSPSGLTAP | 7096 |
| RSR-2738 | TTGRAGGAGNLAPGGLTEP | 7097 |
| RSR-2739 | TTGRAGTATNLPPEGLTGP | 7098 |
| RSR-2740 | TTGRAGGAANLAPTGLTEP | 7099 |
| RSR-2741 | TTGRAGTAENLAPSGLTTP | 7100 |
| RSR-2742 | TTGRAGSATNLGPGGLTGP | 7101 |
| RSR-2743 | TTARAGGAENLTPAGLTEP | 7102 |
| RSR-2744 | TTARAGSAENLSPSGLTGP | 7103 |
| RSR-2745 | TTARAGGAGNLAPEGLTTP | 7104 |
| RSR-2746 | TTSRAGAAENLTPTGLTGP | 7105 |
| RSR-2747 | TYGRTTTPGNEPPASLEAE | 7106 |
| RSR-2748 | TYSRGESGPNEPPPGLTGP | 7107 |
| RSR-2749 | AWGRTGASENETPAPLGGE | 7108 |
| RSR-2750 | RWGRAETTPNTPPEGLETE | 7109 |
| RSR-2751 | ESGRAANHTGAEPPELGAG | 7110 |
| RSR-2754 | TTGRAGEAANLTPAGLTES | 7111 |
| RSR-2755 | TTGRAGEAANLTPAALTES | 7112 |
| RSR-2756 | TTGRAGEAANLTPAPLTES | 7113 |
| RSR-2757 | TTGRAGEAANLTPEPLTES | 7114 |
| RSR-2758 | TTGRAGEAANLTPAGLTGA | 7115 |

TABLE 7a-continued

TCE Release Segment Sequences.

| Name | Amino Acid Sequence | SEQ ID NO |
|------|---------------------|-----------|
| RSR-2759 | TTGRAGEAANLTPEGLTGA | 7116 |
| RSR-2760 | TTGRAGEAANLTPEPLTGA | 7117 |
| RSR-2761 | TTGRAGEAANLTPAGLTEA | 7118 |
| RSR-2762 | TTGRAGEAANLTPEGLTEA | 7119 |
| RSR-2763 | TTGRAGEAANLTPAPLTEA | 7120 |
| RSR-2764 | TTGRAGEAANLTPEPLTEA | 7121 |
| RSR-2765 | TTGRAGEAANLTPEPLTGP | 7122 |
| RSR-2766 | TTGRAGEAANLTPAGLTGG | 7123 |
| RSR-2767 | TTGRAGEAANLTPEGLTGG | 7124 |
| RSR-2768 | TTGRAGEAANLTPEALTGG | 7125 |
| RSR-2769 | TTGRAGEAANLTPEPLTGG | 7126 |
| RSR-2770 | TTGRAGEAANLTPAGLTEG | 7127 |
| RSR-2771 | TTGRAGEAANLTPEGLTEG | 7128 |
| RSR-2772 | TTGRAGEAANLTPAPLTEG | 7129 |
| RSR-2773 | TTGRAGEAANLTPEPLTEG | 7130 |
| RSR-3213 | EAGRSASHTPAGLTGP | 7628 |

TABLE 7b

Release Segment Sequences

| Name | Amino Acid Sequence | SEQ ID NO: |
|------|---------------------|-----------|
| RSN-0001 | GSAPGSAGGYAELRMG GAIATSGSETPGT | 7131 |
| RSN-0002 | GSAPGTGGGYAPLRMG GGAATSGSETPGT | 7132 |
| RSN-0003 | GSAPGAEGGYAALRMG GEIATSGSETPGT | 7133 |
| RSN-0004 | GSAPGGPGGYALLRMG GPAATSGSETPGT | 7134 |
| RSN-0005 | GSAPGEAGGYAFLRMG GSIATSGSETPGT | 7135 |
| RSN-0006 | GSAPGPGGGYASLRMG GTAATSGSETPGT | 7136 |
| RSN-0007 | GSAPGSEGGYATLRMG GAIATSGSETPGT | 7137 |
| RSN-0008 | GSAPGTPGGYANLRMG GGAATSGSETPGT | 7138 |
| RSN-0009 | GSAPGASGGYAHLRMG GEIATSGSETPGT | 7139 |
| RSN-0010 | GSAPGGTGGYGELRMG GPAATSGSETPGT | 7140 |
| RSN-0011 | GSAPGEAGGYPELRMG GSIATSGSETPGT | 7141 |

TABLE 7b-continued

Release Segment Sequences

| Name | Amino Acid Sequence | SEQ ID NO: |
|------|---------------------|-----------|
| RSN-0012 | GSAPGPGGGYVELRMG GTAATSGSETPGT | 7142 |
| RSN-0013 | GSAPGSEGGYLELRMG GAIATSGSETPGT | 7143 |
| RSN-0014 | GSAPGTPGGYSELRMG GGAATSGSETPGT | 7144 |
| RSN-0015 | GSAPGASGGYTELRMG GEIATSGSETPGT | 7145 |
| RSN-0016 | GSAPGGTGGYQELRMG GPAATSGSETPGT | 7146 |
| RSN-0017 | GSAPGEAGGYEELRMG GSIATSGSETPGT | 7147 |
| RSN-0018 | GSAPGPGIGPAELRMGG TAATSGSETPGT | 7148 |
| RSN-0019 | GSAPGSEIGAAELRMG GAIATSGSETPGT | 7149 |
| RSN-0020 | GSAPGTPIGSAELRMGG GAATSGSETPGT | 7150 |
| RSN-0021 | GSAPGASIGTAELRMG GEIATSGSETPGT | 7151 |
| RSN-0022 | GSAPGGTIGNAELRMG GPAATSGSETPGT | 7152 |
| RSN-0023 | GSAPGEAIGQAELRMG GSIATSGSETPGT | 7153 |
| RSN-0024 | GSAPGPGGPYAELRMG GTAATSGSETPGT | 7154 |
| RSN-0025 | GSAPGSEGAYAELRMG GAIATSGSETPGT | 7155 |
| RSN-0026 | GSAPGTPGVYAELRMG GGAATSGSETPGT | 7156 |
| RSN-0027 | GSAPGASGLYAELRMG GEIATSGSETPGT | 7157 |
| RSN-0028 | GSAPGGTGIYAELRMG GPAATSGSETPGT | 7158 |
| RSN-0029 | GSAPGEAGFYAELRMG GSIATSGSETPGT | 7159 |
| RSN-0030 | GSAPGPGGYYAELRMG GTAATSGSETPGT | 7160 |
| RSN-0031 | GSAPGSEGSYAELRMG GAIATSGSETPGT | 7161 |
| RSN-0032 | GSAPGTPGNYAELRMG GGAATSGSETPGT | 7162 |
| RSN-0033 | GSAPGASGEYAELRMG GEIATSGSETPGT | 7163 |
| RSN-0034 | GSAPGGTGHYAELRMG GPAATSGSETPGT | 7164 |
| RSN-0035 | GSAPGEAGGYAEARMG GSIATSGSETPGT | 7165 |
| RSN-0036 | GSAPGPGGGYAEVRMG GTAATSGSETPGT | 7166 |

TABLE 7b-continued

Release Segment Sequences

| Name | Amino Acid Sequence | SEQ ID NO: |
|------|---------------------|------------|
| RSN-0037 | GSAPGSEGGYAEIRMG GAIATSGSETPGT | 7167 |
| RSN-0038 | GSAPGTPGGYAEFRMG GGAATSGSETPGT | 7168 |
| RSN-0039 | GSAPGASGGYAEYRMG GEIATSGSETPGT | 7169 |
| RSN-0040 | GSAPGGTGGYAESRMG GPAATSGSETPGT | 7170 |
| RSN-0041 | GSAPGEAGGYAETRMG GSIATSGSETPGT | 7171 |
| RSN-0042 | GSAPGPGGGYAELAMG GTRATSGSETPGT | 7172 |
| RSN-0043 | GSAPGSEGGYAELVMG GARATSGSETPGT | 7173 |
| RSN-0044 | GSAPGTPGGYAELLMG GGRATSGSETPGT | 7174 |
| RSN-0045 | GSAPGASGGYAELIMG GERATSGSETPGT | 7175 |
| RSN-0046 | GSAPGGTGGYAELWM GGPRATSGSETPGT | 7176 |
| RSN-0047 | GSAPGEAGGYAELSMG GSRATSGSETPGT | 7177 |
| RSN-0048 | GSAPGPGGGYAELTMG GTRATSGSETPGT | 7178 |
| RSN-0049 | GSAPGSEGGYAELQMG GARATSGSETPGT | 7179 |
| RSN-0050 | GSAPGTPGGYAELNMG GGRATSGSETPGT | 7180 |
| RSN-0051 | GSAPGASGGYAELEMG GERATSGSETPGT | 7181 |
| RSN-0052 | GSAPGGTGGYAELRPG GPIATSGSETPGT | 7182 |
| RSN-0053 | GSAPGEAGGYAELRAG GSAATSGSETPGT | 7183 |
| RSN-0054 | GSAPGPGGGYAELRLG GTIATSGSETPGT | 7184 |
| RSN-0055 | GSAPGSEGGYAELRIGG AAATSGSETPGT | 7185 |
| RSN-0056 | GSAPGTPGGYAELRSG GGIATSGSETPGT | 7186 |
| RSN-0057 | GSAPGASGGYAELRNG GEAATSGSETPGT | 7187 |
| RSN-0058 | GSAPGGTGGYAELRQG GPIATSGSETPGT | 7188 |
| RSN-0059 | GSAPGEAGGYAELRDG GSAATSGSETPGT | 7189 |
| RSN-0060 | GSAPGPGGGYAELREG GTIATSGSETPGT | 7190 |

TABLE 7b-continued

Release Segment Sequences

| Name | Amino Acid Sequence | SEQ ID NO: |
|------|---------------------|------------|
| RSN-0061 | GSAPGSEGGYAELRHG GAAATSGSETPGT | 7191 |
| RSN-0062 | GSAPGTPGGYAELRMP GGIATSGSETPGT | 7192 |
| RSN-0063 | GSAPGASGGYAELRMA GEAATSGSETPGT | 7193 |
| RSN-0064 | GSAPGGTGGYAELRMV GPIATSGSETPGT | 7194 |
| RSN-0065 | GSAPGEAGGYAELRML GSAATSGSETPGT | 7195 |
| RSN-0066 | GSAPGPGGGYAELRMI GTIATSGSETPGT | 7196 |
| RSN-0067 | GSAPGSEGGYAELRMY GAIATSGSETPGT | 7197 |
| RSN-0068 | GSAPGTPGGYAELRMS GGAATSGSETPGT | 7198 |
| RSN-0069 | GSAPGASGGYAELRMN GEIATSGSETPGT | 7199 |
| RSN-0070 | GSAPGGTGGYAELRMQ GPAATSGSETPGT | 7200 |
| RSN-0071 | GSAPGANHTPAGLTGP GARATSGSETPGT | 7201 |
| RSN-0072 | GSAPGANTAPEGLTGPS TRATSGSETPGT | 7202 |
| RSN-0073 | GSAPGTGAPPGGLTGPG TRATSGSETPGT | 7203 |
| RSN-0074 | GSAPGANHEPSGLTEGS PRATSGSETPGT | 7204 |
| RSN-0075 | GSAPGANTEPPELGAGT ERATSGSETPGT | 7205 |
| RSN-0076 | GSAPGASGPPPGLTGPP GRATSGSETPGT | 7206 |
| RSN-0077 | GSAPGASGTPAPLGGEP GRATSGSETPGT | 7207 |
| RSN-0078 | GSAPGPAGPPEGLETEA GRATSGSETPGT | 7208 |
| RSN-0079 | GSAPGPTSGQGGLTGPE SRATSGSETPGT | 7209 |
| RSN-0080 | GSAPGSAGGAANLVRG GAIATSGSETPGT | 7210 |
| RSN-0081 | GSAPGTGGGAAPLVRG GGAATSGSETPGT | 7211 |
| RSN-0082 | GSAPGAEGGAAALVRG GEIATSGSETPGT | 7212 |
| RSN-0083 | GSAPGGPGGAALLVRG GPAATSGSETPGT | 7213 |
| RSN-0084 | GSAPGEAGGAAFLVRG GSIATSGSETPGT | 7214 |
| RSN-0085 | GSAPGPGGGAASLVRG GTAATSGSETPGT | 7215 |

TABLE 7b-continued

Release Segment Sequences

| Name | Amino Acid Sequence | SEQ ID NO: |
|------|--------------------|-----|
| RSN-0086 | GSAPGSEGGAATLVRG GAIATSGSETPGT | 7216 |
| RSN-0087 | GSAPGTPGGAAGLVRG GGAATSGSETPGT | 7217 |
| RSN-0088 | GSAPGASGGAADLVRG GEIATSGSETPGT | 7218 |
| RSN-0089 | GSAPGGTGGAGNLVRG GPAATSGSETPGT | 7219 |
| RSN-0090 | GSAPGEAGGAPNLVRG GSIATSGSETPGT | 7220 |
| RSN-0091 | GSAPGPGGGAVNLVRG GTAATSGSETPGT | 7221 |
| RSN-0092 | GSAPGSEGGALNLVRG GAIATSGSETPGT | 7222 |
| RSN-0093 | GSAPGTPGGASNLVRG GGAATSGSETPGT | 7223 |
| RSN-0094 | GSAPGASGGATNLVRG GEIATSGSETPGT | 7224 |
| RSN-0095 | GSAPGGTGGAQNLVRG GPAATSGSETPGT | 7225 |
| RSN-0096 | GSAPGEAGGAENLVRG GSIATSGSETPGT | 7226 |
| RSN-1517 | GSAPEAGRSANHEPLGL VATATSGSETPGT | 7227 |
| BSRS-A1-2 | GSAPASGRSTNAGPSGL AGPATSGSETPGT | 7228 |
| BSRS-A2-2 | GSAPASGRSTNAGPQG LAGQATSGSETPGT | 7229 |
| BSRS-A3-2 | GSAPASGRSTNAGPPGL TGPATSGSETPGT | 7230 |
| VP-1 | GSAPASSRGTNAGPAG LTGPATSGSETPGT | 7231 |
| RSN-1752 | GSAPASSRTTNTGPSTL TGPATSGSETPGT | 7232 |
| RSN-1512 | GSAPAAGRSDNGTPLEL VAPATSGSETPGT | 7233 |
| RSN-1517 | GSAPEAGRSANHEPLGL VATATSGSETPGT | 7234 |
| VP-2 | GSAPASGRGTNAGPAG LTGPATSGSETPGT | 7235 |
| RSN-1018 | GSAPLFGRNDNHEPLEL GGGATSGSETPGT | 7236 |
| RSN-1053 | GSAPTAGRSDNLEPLGL VFGATSGSETPGT | 7237 |
| RSN-1059 | GSAPLDGRSDNFHPPEL VAGATSGSETPGT | 7238 |
| RSN-1065 | GSAPLEGRSDNEEPENL VAGATSGSETPGT | 7239 |
| RSN-1167 | GSAPLKGRSDNNAPLA LVAGATSGSETPGT | 7240 |

TABLE 7b-continued

Release Segment Sequences

| Name | Amino Acid Sequence | SEQ ID NO: |
|------|--------------------|-----|
| RSN-1201 | GSAPVYSRGTNAGPHG LTGRATSGSETPGT | 7241 |
| RSN-1218 | GSAPANSRGTNKGFAG LIGPATSGSETPGT | 7242 |
| RSN-1226 | GSAPASSRLTNEAPAGL TIPATSGSETPGT | 7243 |
| RSN-1254 | GSAPDQSRGTNAGPEG LTDPATSGSETPGT | 7244 |
| RSN-1256 | GSAPESSRGTNIGQGGL TGPATSGSETPGT | 7245 |
| RSN-1261 | GSAPSSSRGTNQDPAGL TIPATSGSETPGT | 7246 |
| RSN-1293 | GSAPASSRGQNHSPMG LTGPATSGSETPGT | 7247 |
| RSN-1309 | GSAPAYSRGPNAGPAG LEGRATSGSETPGT | 7248 |
| RSN-1326 | GSAPASERGNNAGPAN LTGFATSGSETPGT | 7249 |
| RSN-1345 | GSAPASHRGTNPKPAIL TGPATSGSETPGT | 7250 |
| RSN-1354 | GSAPMSSRRTNANPAQ LTGPATSGSETPGT | 7251 |
| RSN-1426 | GSAPGAGRTDNHEPLE LGAAATSGSETPGT | 7252 |
| RSN-1478 | GSAPLAGRSENTAPLEL TAGATSGSETPGT | 7253 |
| RSN-1479 | GSAPLEGRPDNHEPLAL VASATSGSETPGT | 7254 |
| RSN-1496 | GSAPLSGRSDNEEPLAL PAGATSGSETPGT | 7255 |
| RSN-1508 | GSAPEAGRTDNHEPLEL SAPATSGSETPGT | 7256 |
| RSN-1513 | GSAPEGGRSDNHGPLEL VSGATSGSETPGT | 7257 |
| RSN-1516 | GSAPLSGRSDNEAPLEL EAGATSGSETPGT | 7258 |
| RSN-1524 | GSAPLGGRADNHEPPEL GAGATSGSETPGT | 7259 |
| RSN-1622 | GSAPPPSRGTNAEPAGL TGEATSGSETPGT | 7260 |
| RSN-1629 | GSAPASTRGENAGPAG LEAPATSGSETPGT | 7261 |
| RSN-1664 | GSAPESSRGTNGAPEGL TGPATSGSETPGT | 7262 |
| RSN-1667 | GSAPASSRATNESPAGL TGEATSGSETPGT | 7263 |
| RSN-1709 | GSAPASSRGENPPPGGL TGPATSGSETPGT | 7264 |

TABLE 7b-continued

Release Segment Sequences

| Name | Amino Acid Sequence | SEQ ID NO: |
|---|---|---|
| RSN-1712 | GSAPAASRGTNTGPAEL TGSATSGSETPGT | 7265 |
| RSN-1727 | GSAPAGSRTTNAGPGG LEGPATSGSETPGT | 7266 |
| RSN-1754 | GSAPAPSRGENAGPATL TGAATSGSETPGT | 7267 |
| RSN-1819 | GSAPESGRAANTGPPTL TAPATSGSETPGT | 7268 |
| RSN-1832 | GSAPNPGRAANEGPPG LPGSATSGSETPGT | 7269 |
| RSN-1855 | GSAPESSRAANLTPPEL TGPATSGSETPGT | 7270 |
| RSN-1911 | GSAPASGRAANETPPGL TGAATSGSETPGT | 7271 |
| RSN-1929 | GSAPNSGRGENLGAPG LTGTATSGSETPGT | 7272 |
| RSN-1951 | GSAPTTGRAANLTPAG LTGPATSGSETPGT | 7273 |
| RSN-2295 | GSAPEAGRSANHTPAG LTGPATSGSETPGT | 7274 |
| RSN-2298 | GSAPESGRAANTTPAGL TGPATSGSETPGT | 7275 |
| RSN-2038 | GSAPTTGRATEAANLTP AGLTGPATSGSETPGT | 7276 |
| RSN-2072 | GSAPTTGRAEEAANLTP AGLTGPATSGSETPGT | 7277 |
| RSN-2089 | GSAPTTGRAGEAANLT PAGLTGPATSGSETPGT | 7278 |
| RSN-2302 | GSAPTTGRATEAANAT PAGLTGPATSGSETPGT | 7279 |
| RSN-3047 | GSAPTTGRAGEAEGAT SAGATGPATSGSETPGT | 7280 |
| RSN-3052 | GSAPTTGEAGEAANAT SAGATGPATSGSETPGT | 7281 |
| RSN-3043 | GSAPTTGEAGEAAGLTP AGLTGPATSGSETPGT | 7282 |
| RSN-3041 | GSAPTTGAAGEAANAT PAGLTGPATSGSETPGT | 7283 |
| RSN-3044 | GSAPTTGRAGEAAGLT PAGLTGPATSGSETPGT | 7284 |
| RSN-3057 | GSAPTTGRAGEEAANAT SAGATGPATSGSETPGT | 7285 |
| RSN-3058 | GSAPTTGEAGEAAGAT SAGATGPATSGSETPGT | 7286 |
| RSN-2485 | GSAPESGRAANTEPPEL GAGATSGSETPGT | 7287 |
| RSN-2486 | GSAPESGRAANTAPEGL TGPATSGSETPGT | 7288 |

TABLE 7b-continued

Release Segment Sequences

| Name | Amino Acid Sequence | SEQ ID NO: |
|---|---|---|
| RSN-2488 | GSAPEPGRAANHEPSGL TEGATSGSETPGT | 7289 |
| RSN-2599 | GSAPESGRAANHTGAP PGGLTGPATSGSETPGT | 7290 |
| RSN-2706 | GSAPTTGRTGEGANAT PGGLTGPATSGSETPGT | 7291 |
| RSN-2707 | GSAPRTGRSGEAANETP EGLEGPATSGSETPGT | 7292 |
| RSN-2708 | GSAPRTGRTGESANETP AGLGGPATSGSETPGT | 7293 |
| RSN-2709 | GSAPSTGRTGEPANETP AGLSGPATSGSETPGT | 7294 |
| RSN-2710 | GSAPTTGRAGEPANATP TGLSGPATSGSETPGT | 7295 |
| RSN-2711 | GSAPRTGRPGEGANAT PTGLPGPATSGSETPGT | 7296 |
| RSN-2712 | GSAPRTGRGGEAANAT PSGLGGPATSGSETPGT | 7297 |
| RSN-2713 | GSAPSTGRSGESANATP GGLGGPATSGSETPGT | 7298 |
| RSN-2714 | GSAPRTGRTGEEANATP AGLPGPATSGSETPGT | 7299 |
| RSN-2715 | GSAPATGRPGEPANTTP EGLEGPATSGSETPGT | 7300 |
| RSN-2716 | GSAPSTGRSGEPANATP GGLTGPATSGSETPGT | 7301 |
| RSN-2717 | GSAPPTGRGGEGANTTP TGLPGPATSGSETPGT | 7302 |
| RSN-2718 | GSAPPTGRSGEGANATP SGLTGPATSGSETPGT | 7303 |
| RSN-2719 | GSAPTTGRASEGANSTP APLTEPATSGSETPGT | 7304 |
| RSN-2720 | GSAPTYGRAAEAANTT PAGLTAPATSGSETPGT | 7305 |
| RSN-2721 | GSAPTTGRATEGANAT PAELTEPATSGSETPGT | 7306 |
| RSN-2722 | GSAPTVGRASEEANTTP ASLTGPATSGSETPGT | 7307 |
| RSN-2723 | GSAPTTGRAPEAANATP APLTGPATSGSETPGT | 7308 |
| RSN-2724 | GSAPTWGRATEPANAT PAPLTSPATSGSETPGT | 7309 |
| RSN-2725 | GSAPTVGRASESANATP AELTSPATSGSETPGT | 7310 |
| RSN-2726 | GSAPTVGRAPEGANSTP AGLTGPATSGSETPGT | 7311 |
| RSN-2727 | GSAPTWGRATEAPNLE PATLTTPATSGSETPGT | 7312 |

TABLE 7b-continued

Release Segment Sequences

| Name | Amino Acid Sequence | SEQ ID NO: |
|------|---------------------|------------|
| RSN-2728 | GSAPTTGRATEAPNLTP APLTEPATSGSETPGT | 7313 |
| RSN-2729 | GSAPTQGRATEAPNLSP AALTSPATSGSETPGT | 7314 |
| RSN-2730 | GSAPTQGRAAEAPNLTP ATLTAPATSGSETPGT | 7315 |
| RSN-2731 | GSAPTSGRAPEATNLAP APLTGPATSGSETPGT | 7316 |
| RSN-2732 | GSAPTQGRAAEAANLT PAGLTEPATSGSETPGT | 7317 |
| RSN-2733 | GSAPTTGRAGSAPNLPP TGLTTPATSGSETPGT | 7318 |
| RSN-2734 | GSAPTTGRAGGAENLPP EGLTAPATSGSETPGT | 7319 |
| RSN-2735 | GSAPTTSRAGTATNLTP EGLTAPATSGSETPGT | 7320 |
| RSN-2736 | GSAPTTGRAGTATNLPP SGLTTPATSGSETPGT | 7321 |
| RSN-2737 | GSAPTTARAGEAENLSP SGLTAPATSGSETPGT | 7322 |
| RSN-2738 | GSAPTTGRAGGAGNLA PGGLTEPATSGSETPGT | 7323 |
| RSN-2739 | GSAPTTGRAGTATNLPP EGLTGPATSGSETPGT | 7324 |
| RSN-2740 | GSAPTTGRAGGAANLA PTGLTEPATSGSETPGT | 7325 |
| RSN-2741 | GSAPTTGRAGTAENLA PSGLTTPATSGSETPGT | 7326 |
| RSN-2742 | GSAPTTGRAGSATNLGP GGLTGPATSGSETPGT | 7327 |
| RSN-2743 | GSAPTTARAGGAENLT PAGLTEPATSGSETPGT | 7328 |
| RSN-2744 | GSAPTTARAGSAENLSP SGLTGPATSGSETPGT | 7329 |
| RSN-2745 | GSAPTTARAGGAGNLA PEGLTTPATSGSETPGT | 7330 |
| RSN-2746 | GSAPTTSRAGAAENLTP TGLTGPATSGSETPGT | 7331 |
| RSN-2747 | GSAPTYGRTTTPGNEPP ASLEAEATSGSETPGT | 7332 |
| RSN-2748 | GSAPTYSRGESGPNEPP PGLTGPATSGSETPGT | 7333 |
| RSN-2749 | GSAPAWGRTGASENET PAPLGGEATSGSETPGT | 7334 |
| RSN-2750 | GSAPRWGRAETTPNTPP EGLTEATSGSETPGT | 7335 |
| RSN-2751 | GSAPESGRAANHTGAE PPELGAGATSGSETPGT | 7336 |

TABLE 7b-continued

Release Segment Sequences

| Name | Amino Acid Sequence | SEQ ID NO: |
|------|---------------------|------------|
| RSN-2754 | GSAPTTGRAGEAANLT PAGLTESATSGSETPGT | 7337 |
| RSN-2755 | GSAPTTGRAGEAANLT PAALTESATSGSETPGT | 7338 |
| RSN-2756 | GSAPTTGRAGEAANLT PAPLTESATSGSETPGT | 7339 |
| RSN-2757 | GSAPTTGRAGEAANLT PEPLTESATSGSETPGT | 7340 |
| RSN-2758 | GSAPTTGRAGEAANLT PAGLTGAATSGSETPGT | 7341 |
| RSN-2759 | GSAPTTGRAGEAANLT PEGLTGAATSGSETPGT | 7342 |
| RSN-2760 | GSAPTTGRAGEAANLT PEPLTGAATSGSETPGT | 7343 |
| RSN-2761 | GSAPTTGRAGEAANLT PAGLTEAATSGSETPGT | 7344 |
| RSN-2762 | GSAPTTGRAGEAANLT PEGLTEAATSGSETPGT | 7345 |
| RSN-2763 | GSAPTTGRAGEAANLT PAPLTEAATSGSETPGT | 7346 |
| RSN-2764 | GSAPTTGRAGEAANLT PEPLTEAATSGSETPGT | 7347 |
| RSN-2765 | GSAPTTGRAGEAANLT PEPLTGPATSGSETPGT | 7348 |
| RSN-2766 | GSAPTTGRAGEAANLT PAGLTGGATSGSETPGT | 7349 |
| RSN-2767 | GSAPTTGRAGEAANLT PEGLTGGATSGSETPGT | 7350 |
| RSN-2768 | GSAPTTGRAGEAANLT PEALTGGATSGSETPGT | 7351 |
| RSN-2769 | GSAPTTGRAGEAANLT PEPLTGGATSGSETPGT | 7352 |
| RSN-2770 | GSAPTTGRAGEAANLT PAGLTEGATSGSETPGT | 7353 |
| RSN-2771 | GSAPTTGRAGEAANLT PEGLTEGATSGSETPGT | 7354 |
| RSN-2772 | GSAPTTGRAGEAANLT PAPLTEGATSGSETPGT | 7355 |
| RSN-2773 | GSAPTTGRAGEAANLT PEPLTEGATSGSETPGT | 7356 |
| RSN-3047 | GSAPTTGRAGEAEGAT SAGATGPATSGSETPGT | 7357 |
| RSN-2783 | GSAPEAGRSAEATSAG ATGPATSGSETPGT | 7358 |
| RSN-3107 | GSAPSASGTYSRGESGP GSPATSGSETPGT | 7359 |
| RSN-3103 | GSAPSASGEAGRTDTHP GSPATSGSETPGT | 7360 |
| RSN-3102 | GSAPSASGEPGRAAEHP GSPATSGSETPGT | 7361 |

TABLE 7b-continued

Release Segment Sequences

| Name | Amino Acid Sequence | SEQ ID NO: |
|------|---------------------|------------|
| RSN-3119 | GSAPSPAGESSRGTTIA GSPATSGSETPGT | 7362 |
| RSN-3043 | GSAPTTGEAGEAAGLTP AGLTGPATSGSETPGT | 7363 |
| RSN-2789 | GSAPEAGESAGATPAG LTGPATSGSETPGT | 7364 |
| RSN-3109 | GSAPSASGAPLELEAGP GSPATSGSETPGT | 7365 |
| RSN-3110 | GSAPSASGEPPELGAGP GSPATSGSETPGT | 7366 |
| RSN-3111 | GSAPSASGEPSGLTEGP GSPATSGSETPGT | 7367 |
| RSN-3112 | GSAPSASGTPAPLTEPP GSPATSGSETPGT | 7368 |
| RSN-3113 | GSAPSASGTPAELTEPP GSPATSGSETPGT | 7369 |
| RSN-3114 | GSAPSASGPPPGLTGPP GSPATSGSETPGT | 7370 |
| RSN-3115 | GSAPSASGTPAPLGGEP GSPATSGSETPGT | 7371 |
| RSN-3125 | GSAPSPAGAPEGLTGPA GSPATSGSETPGT | 7372 |
| RSN-3126 | GSAPSPAGPPEGLETEA GSPATSGSETPGT | 7373 |
| RSN-3127 | GSAPSPTSGQGGLTGPG SEPATSGSETPGT | 7374 |
| RSN-3131 | GSAPSESAPPEGLETEST EPATSGSETPGT | 7375 |
| RSN-3132 | GSAPSEGSEPLELGAAS ETPATSGSETPGT | 7376 |
| RSN-3133 | GSAPSEGSGPAGLEAPS ETPATSGSETPGT | 7377 |
| RSN-3138 | GSAPSEPTPPASLEAEPG SPATSGSETPGT | 7378 |
| RSC-0001 | GTAEAASASGGSAGGY AELRMGGAIPGSP | 7379 |
| RSC-0002 | GTAEAASASGGTGGGY APLRMGGGAPGSP | 7380 |
| RSC-0003 | GTAEAASASGGAEGGY AALRMGGEIPGSP | 7381 |
| RSC-0004 | GTAEAASASGGPGGY ALLRMGGPAPGSP | 7382 |
| RSC-0005 | GTAEAASASGGEAGGY AFLRMGGSIPGSP | 7383 |
| RSC-0006 | GTAEAASASGGPGGGY ASLRMGGTAPGSP | 7384 |
| RSC-0007 | GTAEAASASGGSEGGY ATLRMGGAIPGSP | 7385 |
| RSC-0008 | GTAEAASASGGTPGGY ANLRMGGGAPGSP | 7386 |

TABLE 7b-continued

Release Segment Sequences

| Name | Amino Acid Sequence | SEQ ID NO: |
|------|---------------------|------------|
| RSC-0009 | GTAEAASASGGASGGY AHLRMGGEIPGSP | 7387 |
| RSC-0010 | GTAEAASASGGGTGGY GELRMGGPAPGSP | 7388 |
| RSC-0011 | GTAEAASASGGEAGGY PELRMGGSIPGSP | 7389 |
| RSC-0012 | GTAEAASASGGPGGGY VELRMGGTAPGSP | 7390 |
| RSC-0013 | GTAEAASASGGSEGGY LELRMGGAIPGSP | 7391 |
| RSC-0014 | GTAEAASASGGTPGGY SELRMGGGAPGSP | 7392 |
| RSC-0015 | GTAEAASASGGASGGY TELRMGGEIPGSP | 7393 |
| RSC-0016 | GTAEAASASGGGTGGY QELRMGGPAPGSP | 7394 |
| RSC-0017 | GTAEAASASGGEAGGY EELRMGGSIPGSP | 7395 |
| RSC-0018 | GTAEAASASGGPGIGPA ELRMGGTAPGSP | 7396 |
| RSC-0019 | GTAEAASASGGSEIGAA ELRMGGAIPGSP | 7397 |
| RSC-0020 | GTAEAASASGGTPIGSA ELRMGGGAPGSP | 7398 |
| RSC-0021 | GTAEAASASGGASIGTA ELRMGGEIPGSP | 7399 |
| RSC-0022 | GTAEAASASGGGTIGN AELRMGGPAPGSP | 7400 |
| RSC-0023 | GTAEAASASGGEAIGQ AELRMGGSIPGSP | 7401 |
| RSC-0024 | GTAEAASASGGPGGPY AELRMGGTAPGSP | 7402 |
| RSC-0025 | GTAEAASASGGSEGAY AELRMGGAIPGSP | 7403 |
| RSC-0026 | GTAEAASASGGTPGVY AELRMGGGAPGSP | 7404 |
| RSC-0027 | GTAEAASASGGASGLY AELRMGGEIPGSP | 7405 |
| RSC-0028 | GTAEAASASGGGTGIY AELRMGGPAPGSP | 7406 |
| RSC-0029 | GTAEAASASGGEAGFY AELRMGGSIPGSP | 7407 |
| RSC-0030 | GTAEAASASGGPGGYY AELRMGGTAPGSP | 7408 |
| RSC-0031 | GTAEAASASGGSEGSY AELRMGGAIPGSP | 7409 |
| RSC-0032 | GTAEAASASGGTPGNY AELRMGGGAPGSP | 7410 |

TABLE 7b-continued

Release Segment Sequences

| Name | Amino Acid Sequence | SEQ ID NO: |
|---|---|---|
| RSC-0033 | GTAEAASASGGASGEY AELRMGGEIPGSP | 7411 |
| RSC-0034 | GTAEAASASGGGTGHY AELRMGGPAPGSP | 7412 |
| RSC-0035 | GTAEAASASGGEAGGY AEARMGGSIPGSP | 7413 |
| RSC-0036 | GTAEAASASGGPGGGY AEVRMGGTAPGSP | 7414 |
| RSC-0037 | GTAEAASASGGSEGGY AEIRMGGAIPGSP | 7415 |
| RSC-0038 | GTAEAASASGGTPGGY AEFRMGGGAPGSP | 7416 |
| RSC-0039 | GTAEAASASGGASGGY AEYRMGGEIPGSP | 7417 |
| RSC-0040 | GTAEAASASGGGTGGY AESRMGGPAPGSP | 7418 |
| RSC-0041 | GTAEAASASGGEAGGY AETRMGGSIPGSP | 7419 |
| RSC-0042 | GTAEAASASGGPGGGY AELAMGGTRPGSP | 7420 |
| RSC-0043 | GTAEAASASGGSEGGY AELVMGGARPGSP | 7421 |
| RSC-0044 | GTAEAASASGGTPGGY AELLMGGGRPGSP | 7422 |
| RSC-0045 | GTAEAASASGGASGGY AELIMGGERPGSP | 7423 |
| RSC-0046 | GTAEAASASGGGTGGY AELWMGGPRPGSP | 7424 |
| RSC-0047 | GTAEAASASGGEAGGY AELSMGGSRPGSP | 7425 |
| RSC-0048 | GTAEAASASGGPGGGY AELTMGGTRPGSP | 7426 |
| RSC-0049 | GTAEAASASGGSEGGY AELQMGGARPGSP | 7427 |
| RSC-0050 | GTAEAASASGGTPGGY AELNMGGGRPGSP | 7428 |
| RSC-0051 | GTAEAASASGGASGGY AELEMGGERPGSP | 7429 |
| RSC-0052 | GTAEAASASGGGTGGY AELRPGGPIPGSP | 7430 |
| RSC-0053 | GTAEAASASGGEAGGY AELRAGGSAPGSP | 7431 |
| RSC-0054 | GTAEAASASGGPGGGY AELRLGGTIPGSP | 7432 |
| RSC-0055 | GTAEAASASGGSEGGY AELRIGGAAPGSP | 7433 |
| RSC-0056 | GTAEAASASGGTPGGY AELRSGGGIPGSP | 7434 |

TABLE 7b-continued

Release Segment Sequences

| Name | Amino Acid Sequence | SEQ ID NO: |
|---|---|---|
| RSC-0057 | GTAEAASASGGASGGY AELRNGGEAPGSP | 7435 |
| RSC-0058 | GTAEAASASGGGTGGY AELRQGGPIPGSP | 7436 |
| RSC-0059 | GTAEAASASGGEAGGY AELRDGGSAPGSP | 7437 |
| RSC-0060 | GTAEAASASGGPGGGY AELREGGTIPGSP | 7438 |
| RSC-0061 | GTAEAASASGGSEGGY AELRHGGAAPGSP | 7439 |
| RSC-0062 | GTAEAASASGGTPGGY AELRMPGGIPGSP | 7440 |
| RSC-0063 | GTAEAASASGGASGGY AELRMAGEAPGSP | 7441 |
| RSC-0064 | GTAEAASASGGGTGGY AELRMVGPIPGSP | 7442 |
| RSC-0065 | GTAEAASASGGEAGGY AELRMLGSAPGSP | 7443 |
| RSC-0066 | GTAEAASASGGPGGGY AELRMIGTIPGSP | 7444 |
| RSC-0067 | GTAEAASASGGSEGGY AELRMYGAIPGSP | 7445 |
| RSC-0068 | GTAEAASASGGTPGGY AELRMSGGAPGSP | 7446 |
| RSC-0069 | GTAEAASASGGASGGY AELRMNGEIPGSP | 7447 |
| RSC-0070 | GTAEAASASGGGTGGY AELRMQGPAPGSP | 7448 |
| RSC-0071 | GTAEAASASGGANHTP AGLTGPGARPGSP | 7449 |
| RSC-0072 | GTAEAASASGGANTAP EGLTGPSTRPGSP | 7450 |
| RSC-0073 | GTAEAASASGGTGAPP GGLTGPGTRPGSP | 7451 |
| RSC-0074 | GTAEAASASGGANHEP SGLTEGSPRPGSP | 7452 |
| RSC-0075 | GTAEAASASGGANTEP PELGAGTERPGSP | 7453 |
| RSC-0076 | GTAEAASASGGASGPPP GLTGPPGRPGSP | 7454 |
| RSC-0077 | GTAEAASASGGASGTP APLGGEPGRPGSP | 7455 |
| RSC-0078 | GTAEAASASGGPAGPPE GLETEAGRPGSP | 7456 |
| RSC-0079 | GTAEAASASGGPTSGQ GGLTGPESRPGSP | 7457 |
| RSC-0080 | GTAEAASASGGSAGGA ANLVRGGAIPGSP | 7458 |
| RSC-0081 | GTAEAASASGGTGGGA APLVRGGGAPGSP | 7459 |

TABLE 7b-continued

Release Segment Sequences

| Name | Amino Acid Sequence | SEQ ID NO: |
|------|---------------------|------------|
| RSC-0082 | GTAEAASASGGAEGGA AALVRGGEIPGSP | 7460 |
| RSC-0083 | GTAEAASASGGGPGGA ALLVRGGPAPGSP | 7461 |
| RSC-0084 | GTAEAASASGGEAGGA AFLVRGGSIPGSP | 7462 |
| RSC-0085 | GTAEAASASGGPGGGA ASLVRGGTAPGSP | 7463 |
| RSC-0086 | GTAEAASASGGSEGGA ATLVRGGAIPGSP | 7464 |
| RSC-0087 | GTAEAASASGGTPGGA AGLVRGGGAPGSP | 7465 |
| RSC-0088 | GTAEAASASGGASGGA ADLVRGGEIPGSP | 7466 |
| RSC-0089 | GTAEAASASGGGTGGA GNLVRGGPAPGSP | 7467 |
| RSC-0090 | GTAEAASASGGEAGGA PNLVRGGSIPGSP | 7468 |
| RSC-0091 | GTAEAASASGGPGGGA VNLVRGGTAPGSP | 7469 |
| RSC-0092 | GTAEAASASGGSEGGA LNLVRGGAIPGSP | 7470 |
| RSC-0093 | GTAEAASASGGTPGGA SNLVRGGGAPGSP | 7471 |
| RSC-0094 | GTAEAASASGGASGGA TNLVRGGEIPGSP | 7472 |
| RSC-0095 | GTAEAASASGGGTGGA QNLVRGGPAPGSP | 7473 |
| RSC-0096 | GTAEAASASGGEAGGA ENLVRGGSIPGSP | 7474 |
| RSC-1517 | GTAEAASASGEAGRSA NHEPLGLVATPGSP | 7475 |
| BSRS-A1-3 | GTAEAASASGASGRST NAGPSGLAGPPGSP | 7476 |
| BSRS-A2-3 | GTAEAASASGASGRST NAGPQGLAGQPGSP | 7477 |
| BSRS-A3-3 | GTAEAASASGASGRST NAGPPGLTGPPGSP | 7478 |
| VP-1 | GTAEAASASGASSRGT NAGPAGLTGPPGSP | 7479 |
| RSC-1752 | GTAEAASASGASSRTTN TGPSTLTGPPGSP | 7480 |
| RSC-1512 | GTAEAASASGAAGRSD NGTPLELVAPPGSP | 7481 |
| RSC-1517 | GTAEAASASGEAGRSA NHEPLGLVATPGSP | 7482 |
| VP-2 | GTAEAASASGASGRGT NAGPAGLTGPPGSP | 7483 |
| RSC-1018 | GTAEAASASGLFGRND NHEPLELGGGPGSP | 7484 |

TABLE 7b-continued

Release Segment Sequences

| Name | Amino Acid Sequence | SEQ ID NO: |
|------|---------------------|------------|
| RSC-1053 | GTAEAASASGTAGRSD NLEPLGLVFGPGSP | 7485 |
| RSC-1059 | GTAEAASASGLDGRSD NFHPPELVAGPGSP | 7486 |
| RSC-1065 | GTAEAASASGLEGRSD NEEPENLVAGPGSP | 7487 |
| RSC-1167 | GTAEAASASGLKGRSD NNAPLALVAGPGSP | 7488 |
| RSC-1201 | GTAEAASASGVYSRGT NAGPHGLTGRPGSP | 7489 |
| RSC-1218 | GTAEAASASGANSRGT NKGFAGLIGPPGSP | 7490 |
| RSC-1226 | GTAEAASASGASSRLTN EAPAGLTIPPGSP | 7491 |
| RSC-1254 | GTAEAASASGDQSRGT NAGPEGLTDPPGSP | 7492 |
| RSC-1256 | GTAEAASASGESSRGTN IGQGGLTGPPGSP | 7493 |
| RSC-1261 | GTAEAASASGSSSRGTN QDPAGLTIPPGSP | 7494 |
| RSC-1293 | GTAEAASASGASSRGQ NHSPMGLTGPPGSP | 7495 |
| RSC-1309 | GTAEAASASGAYSRGP NAGPAGLEGRPGSP | 7496 |
| RSC-1326 | GTAEAASASGASERGN NAGPANLTGFPGSP | 7497 |
| RSC-1345 | GTAEAASASGASHRGT NPKPAILTGPPGSP | 7498 |
| RSC-1354 | GTAEAASASGMSSRRT NANPAQLTGPPGSP | 7499 |
| RSC-1426 | GTAEAASASGGAGRTD NHEPLELGAAPGSP | 7500 |
| RSC-1478 | GTAEAASASGLAGRSE NTAPLELTAGPGSP | 7501 |
| RSC-1479 | GTAEAASASGLEGRPD NHEPLALVASPGSP | 7502 |
| RSC-1496 | GTAEAASASGLSGRSD NEEPLALPAGPGSP | 7503 |
| RSC-1508 | GTAEAASASGEAGRTD NHEPLELSAPPGSP | 7504 |
| RSC-1513 | GTAEAASASGEGGRSD NHGPLELVSGPGSP | 7505 |
| RSC-1516 | GTAEAASASGLSGRSD NEAPLELEAGPGSP | 7506 |
| RSC-1524 | GTAEAASASGLGGRAD NHEPPELGAGPGSP | 7507 |
| RSC-1622 | GTAEAASASGPPSRGTN AEPAGLTGEPGSP | 7508 |

TABLE 7b-continued

Release Segment Sequences

| Name | Amino Acid Sequence | SEQ ID NO: |
|---|---|---|
| RSC-1629 | GTAEAASASGASTRGE NAGPAGLEAPPGSP | 7509 |
| RSC-1664 | GTAEAASASGESSRGTN GAPEGLTGPPGSP | 7510 |
| RSC-1667 | GTAEAASASGASSRAT NESPAGLTGEPGSP | 7511 |
| RSC-1709 | GTAEAASASGASSRGE NPPPGGLTGPPGSP | 7512 |
| RSC-1712 | GTAEAASASGAASRGT NTGPAELTGSPGSP | 7513 |
| RSC-1727 | GTAEAASASGAGSRTT NAGPGGLEGPPGSP | 7514 |
| RSC-1754 | GTAEAASASGAPSRGE NAGPATLTGAPGSP | 7515 |
| RSC-1819 | GTAEAASASGESGRAA NTGPPTLTAPPGSP | 7516 |
| RSC-1832 | GTAEAASASGNPGRAA NEGPPGLPGSPGSP | 7517 |
| RSC-1855 | GTAEAASASGESSRAA NLTPPELTGPPGSP | 7518 |
| RSC-1911 | GTAEAASASGASGRAA NETPPGLTGAPGSP | 7519 |
| RSC-1929 | GTAEAASASGNSGRGE NLGAPGLTGTPGSP | 7520 |
| RSC-1951 | GTAEAASASGTTGRAA NLTPAGLTGPPGSP | 7521 |
| RSC-2295 | GTAEAASASGEAGRSA NHTPAGLTGPPGSP | 7522 |
| RSC-2298 | GTAEAASASGESGRAA NTTPAGLTGPPGSP | 7523 |
| RSC-2038 | GTAEAASASGTTGRAT EAANLTPAGLTGPPGSP | 7524 |
| RSC-2072 | GTAEAASASGTTGRAE EAANLTPAGLTGPPGSP | 7525 |
| RSC-2089 | GTAEAASASGTTGRAG EAANLTPAGLTGPPGSP | 7526 |
| RSC-2302 | GTAEAASASGTTGRAT EAANATPAGLTGPPGSP | 7527 |
| RSC-3047 | GTAEAASASGTTGRAG EAEGATSAGATGPPGSP | 7528 |
| RSC-3052 | GTAEAASASGTTGEAG EAANATSAGATGPPGSP | 7529 |
| RSC-3043 | GTAEAASASGTTGEAG EAAGLTPAGLTGPPGSP | 7530 |
| RSC-3041 | GTAEAASASGTTGAAG EAANATPAGLTGPPGSP | 7531 |
| RSC-3044 | GTAEAASASGTTGRAG EAAGLTPAGLTGPPGSP | 7532 |

TABLE 7b-continued

Release Segment Sequences

| Name | Amino Acid Sequence | SEQ ID NO: |
|---|---|---|
| RSC-3057 | GTAEAASASGTTGRAG EAANATSAGATGPPGSP | 7533 |
| RSC-3058 | GTAEAASASGTTGEAG EAAGATSAGATGPPGSP | 7534 |
| RSC-2485 | GTAEAASASGESGRAA NTEPPELGAGPGSP | 7535 |
| RSC-2486 | GTAEAASASGESGRAA NTAPEGLTGPPGSP | 7536 |
| RSC-2488 | GTAEAASASGEPGRAA NHEPSGLTEGPGSP | 7537 |
| RSC-2599 | GTAEAASASGESGRAA NHTGAPPGGLTGPPGSP | 7538 |
| RSC-2706 | GTAEAASASGTTGRTG EGANATPGGLTGPPGSP | 7539 |
| RSC-2707 | GTAEAASASGRTGRSG EAANETPEGLEGPPGSP | 7540 |
| RSC-2708 | GTAEAASASGRTGRTG ESANETPAGLGGPPGSP | 7541 |
| RSC-2709 | GTAEAASASGSTGRTG EPANETPAGLSGPPGSP | 7542 |
| RSC-2710 | GTAEAASASGTTGRAG EPANATPTGLSGPPGSP | 7543 |
| RSC-2711 | GTAEAASASGRTGRPG EGANATPTGLPGPPGSP | 7544 |
| RSC-2712 | GTAEAASASGRTGRGG EAANATPSGLGGPPGSP | 7545 |
| RSC-2713 | GTAEAASASGSTGRSGE SANATPGGLGGPPGSP | 7546 |
| RSC-2714 | GTAEAASASGRTGRTG EEANATPAGLPGPPGSP | 7547 |
| RSC-2715 | GTAEAASASGATGRPG EPANTTPEGLEGPPGSP | 7548 |
| RSC-2716 | GTAEAASASGSTGRSGE PANATPGGLTGPPGSP | 7549 |
| RSC-2717 | GTAEAASASGPTGRGG EGANTTPTGLPGPPGSP | 7550 |
| RSC-2718 | GTAEAASASGPTGRSGE GANATPSGLTGPPGSP | 7551 |
| RSC-2719 | GTAEAASASGTTGRAS EGANSTPAPLTEPPGSP | 7552 |
| RSC-2720 | GTAEAASASGTYGRAA EAANTTPAGLTAPPGSP | 7553 |
| RSC-2721 | GTAEAASASGTTGRAT EGANATPAELTEPPGSP | 7554 |
| RSC-2722 | GTAEAASASGTVGRAS EEANTTPASLTGPPGSP | 7555 |
| RSC-2723 | GTAEAASASGTTGRAP EAANATPAPLTGPPGSP | 7556 |
| RSC-2724 | GTAEAASASGTWGRAT EPANATPAPLTSPPGSP | 7557 |

TABLE 7b-continued

Release Segment Sequences

| Name | Amino Acid Sequence | SEQ ID NO: |
|------|---------------------|------------|
| RSC-2725 | GTAEAASASGTVGRAS ESANATPAELTSPPGSP | 7558 |
| RSC-2726 | GTAEAASASGTVGRAP EGANSTPAGLTGPPGSP | 7559 |
| RSC-2727 | GTAEAASASGTWGRAT EAPNLEPATLTTPPGSP | 7560 |
| RSC-2728 | GTAEAASASGTTGRAT EAPNLTPAPLTEPPGSP | 7561 |
| RSC-2729 | GTAEAASASGTQGRAT EAPNLSPAALTSPPGSP | 7562 |
| RSC-2730 | GTAEAASASGTQGRAA EAPNLTPATLTAPPGSP | 7563 |
| RSC-2731 | GTAEAASASGTSGRAPE ATNLAPAPLTGPPGSP | 7564 |
| RSC-2732 | GTAEAASASGTQGRAA EAANLTPAGLTEPPGSP | 7565 |
| RSC-2733 | GTAEAASASGTTGRAG SAPNLPPTGLTTPPGSP | 7566 |
| RSC-2734 | GTAEAASASGTTGRAG GAENLPPEGLTAPPGSP | 7567 |
| RSC-2735 | GTAEAASASGTTSRAG TATNLTPEGLTAPPGSP | 7568 |
| RSC-2736 | GTAEAASASGTTGRAG TATNLPPSGLTTPPGSP | 7569 |
| RSC-2737 | GTAEAASASGTTARAG EAENLSPSGLTAPPGSP | 7570 |
| RSC-2738 | GTAEAASASGTTGRAG GAGNLAPGGLTEPPGSP | 7571 |
| RSC-2739 | GTAEAASASGTTGRAG TATNLPPEGLTGPPGSP | 7572 |
| RSC-2740 | GTAEAASASGTTGRAG GAANLAPTGLTEPPGSP | 7573 |
| RSC-2741 | GTAEAASASGTTGRAG TAENLAPSGLTTPPGSP | 7574 |
| RSC-2742 | GTAEAASASGTTGRAG SATNLGPGGLTGPPGSP | 7575 |
| RSC-2743 | GTAEAASASGTTARAG GAENLTPAGLTEPPGSP | 7576 |
| RSC-2744 | GTAEAASASGTTARAG SAENLSPSGLTGPPGSP | 7577 |
| RSC-2745 | GTAEAASASGTTARAG GAGNLAPEGLTTPPGSP | 7578 |
| RSC-2746 | GTAEAASASGTTSRAG AAENLTPTGLTGPPGSP | 7579 |
| RSC-2747 | GTAEAASASGTYGRTT TPGNEPPASLEAEPGSP | 7580 |
| RSC-2748 | GTAEAASASGTYSRGES GPNEPPPGLTGPPGSP | 7581 |
| RSC-2749 | GTAEAASASGAWGRTG ASENETPAPLGGEPGSP | 7582 |

TABLE 7b-continued

Release Segment Sequences

| Name | Amino Acid Sequence | SEQ ID NO: |
|------|---------------------|------------|
| RSC-2750 | GTAEAASASGRWGRAE TTPNTPPEGLETEPGSP | 7583 |
| RSC-2751 | GTAEAASASGESGRAA NHTGAEPPELGAGPGSP | 7584 |
| RSC-2754 | GTAEAASASGTTGRAG EAANLTPAGLTESPGSP | 7585 |
| RSC-2755 | GTAEAASASGTTGRAG EAANLTPAALTESPGSP | 7586 |
| RSC-2756 | GTAEAASASGTTGRAG EAANLTPAPLTESPGSP | 7587 |
| RSC-2757 | GTAEAASASGTTGRAG EAANLTPEPLTESPGSP | 7588 |
| RSC-2758 | GTAEAASASGTTGRAG EAANLTPAGLTGAPGSP | 7589 |
| RSC-2759 | GTAEAASASGTTGRAG EAANLTPEGLTGAPGSP | 7590 |
| RSC-2760 | GTAEAASASGTTGRAG EAANLTPEPLTGAPGSP | 7591 |
| RSC-2761 | GTAEAASASGTTGRAG EAANLTPAGLTEAPGSP | 7592 |
| RSC-2762 | GTAEAASASGTTGRAG EAANLTPEGLTEAPGSP | 7593 |
| RSC-2763 | GTAEAASASGTTGRAG EAANLTPAPLTEAPGSP | 7594 |
| RSC-2764 | GTAEAASASGTTGRAG EAANLTPEPLTEAPGSP | 7595 |
| RSC-2765 | GTAEAASASGTTGRAG EAANLTPEPLTGPPGSP | 7596 |
| RSC-2766 | GTAEAASASGTTGRAG EAANLTPAGLTGGPGSP | 7597 |
| RSC-2767 | GTAEAASASGTTGRAG EAANLTPEGLTGGPGSP | 7598 |
| RSC-2768 | GTAEAASASGTTGRAG EAANLTPEALTGGPGSP | 7599 |
| RSC-2769 | GTAEAASASGTTGRAG EAANLTPEPLTGGPGSP | 7600 |
| RSC-2770 | GTAEAASASGTTGRAG EAANLTPAGLTEGPGSP | 7601 |
| RSC-2771 | GTAEAASASGTTGRAG EAANLTPEGLTEGPGSP | 7602 |
| RSC-2772 | GTAEAASASGTTGRAG EAANLTPAPLTEGPGSP | 7603 |
| RSC-2773 | GTAEAASASGTTGRAG EAANLTPEPLTEGPGSP | 7604 |
| RSC-3047 | GTAEAASASGTTGRAG EAEGATSAGATGPPGSP | 7605 |
| RSC-2783 | GTAEAASASGEAGRSA EATSAGATGPPGSP | 7606 |

TABLE 7b-continued

Release Segment Sequences

| Name | Amino Acid Sequence | SEQ ID NO: |
|------|---------------------|------------|
| RSC-3107 | GTAEAASASGSASGTYS RGESGPGSPPGSP | 7607 |
| RSC-3103 | GTAEAASASGSASGEA GRTDTHPGSPPGSP | 7608 |
| RSC-3102 | GTAEAASASGSASGEPG RAAEHPGSPPGSP | 7609 |
| RSC-3119 | GTAEAASASGSPAGESS RGTTIAGSPPGSP | 7610 |
| RSC-3043 | GTAEAASASGTTGEAG EAAGLTPAGLTGPPGSP | 7611 |
| RSC-2789 | GTAEAASASGEAGESA GATPAGLTGPPGSP | 7612 |
| RSC-3109 | GTAEAASASGSASGAPL ELEAGPGSPPGSP | 7613 |
| RSC-3110 | GTAEAASASGSASGEPP ELGAGPGSPPGSP | 7614 |
| RSC-3111 | GTAEAASASGSASGEPS GLTEGPGSPPGSP | 7615 |
| RSC-3112 | GTAEAASASGSASGTPA PLTEPPGSPPGSP | 7616 |
| RSC-3113 | GTAEAASASGSASGTPA ELTEPPGSPPGSP | 7617 |
| RSC-3114 | GTAEAASASGSASGPPP GLTGPPGSPPGSP | 7618 |
| RSC-3115 | GTAEAASASGSASGTPA PLGGEPGSPPGSP | 7619 |
| RSC-3125 | GTAEAASASGSPAGAPE GLTGPAGSPPGSP | 7620 |
| RSC-3126 | GTAEAASASGSPAGPPE GLETEAGSPPGSP | 7621 |
| RSC-3127 | GTAEAASASGSPTSGQG GLTGPGSEPPGSP | 7622 |
| RSC-3131 | GTAEAASASGSESAPPE GLETESTEPPGSP | 7623 |
| RSC-3132 | GTAEAASASGSEGSEPL ELGAASETPPGSP | 7624 |
| RSC-3133 | GTAEAASASGSEGSGPA GLEAPSETPPGSP | 7625 |
| RSC-3138 | GTAEAASASGSEPTPPA SLEAEPGSPPGSP | 7626 |

In some embodiments, a paTCE comprises an RS1 and an RS2 that have different rates of cleavage and different cleavage efficiencies to multiple proteases for which they are substrates. As a given protease may be found in different concentrations in a tumor, compared to healthy tissues or in circulation, the disclosure provides RSs that have a higher or lower cleavage efficiency for a given protease in order to ensure that a paTCE is preferentially converted from the inactive form to the active form (i.e., by the separation and release of the binding moieties and ELNNs from the paTCE after cleavage of the RSs) when in proximity to the cancer cell or tissue and its co-localized proteases compared to the rate of cleavage of the RSs in healthy tissue or the circulation such that the released binding moieties of the TCE have a greater ability to bind to ligands in the tumor compared to the inactive form that remains in circulation. By such selective designs, the therapeutic index of the resulting compositions can be improved, resulting in reduced side effects relative to convention therapeutics that do not incorporate such site-specific activation.

In some embodiments, cleavage efficiency is the log 2 value of the ratio of the percentage of the test substrate comprising the RS cleaved to the percentage of the control substrate AC1611 cleaved when each is subjected to the protease enzyme in biochemical assays in which reaction in conducted wherein the initial substrate concentration is 6 µM, the reactions are incubated at 37° C. for 2 hours before being stopped by adding EDTA, with the amount of digestion products and uncleaved substrate analyzed by non-reducing SDS-PAGE to establish the ratio of the percentage cleaved. The cleavage efficiency may be calculated as follows:

$$\mathrm{Log_2}\left(\frac{\%\ \text{Cleaved for substrate of interest}}{\%\ \text{cleaved for AC1611 in the same experiment}}\right).$$

Thus, a cleavage efficiency of −1 means that the amount of test substrate cleaved was 50% compared to that of the control substrate, while a cleavage efficiency of +1 means that the amount of test substrate cleaved was 200% compared to that of the control substrate. A higher rate of cleavage by the test protease relative to the control would result in a higher cleavage efficiency, and a slower rate of cleavage by the test protease relative to the control would result in a lower cleavage efficiency. A control RS sequence AC1611 (RSR-1517), having the amino acid sequence EAGRSANHEPLGLVAT (SEQ ID NO: 7001), was established as having an appropriate baseline cleavage efficiency by the proteases legumain, MMP-2, MMP-7, MMP-9, MMP-14, uPA, and matriptase, when tested in in vitro biochemical assays for rates of cleavage by the individual proteases. By selective substitution of amino acids at individual locations in the RS peptides, libraries of RS were created and evaluated against the panel of the 7 proteases, resulting in profiles that were used to establish guidelines for appropriate amino acid substitutions in order to achieve RS with desired cleavage efficiencies. In some embodiments, in making RSs with desired cleavage efficiencies, substitutions using the hydrophilic amino acids A. E. G. P. S. and T are preferred, however other L-amino acids can be substituted at given positions in order to adjust the cleavage efficiency so long as the RSs retain at least some susceptibility to cleavage by a given protease. Conservative substitutions of amino acids in a peptide to retain or effect activity is well within the knowledge and capabilities of a person within skill in the art. In some embodiments, the disclosure provides an RS in which the RS is cleaved by a protease including but not limited to MMP-2, MMP-7, MMP-9, MMP-14, uPA, or matriptase (also known as MT-SP1) with at least a 0.2 log 2, or 0.4 log 2, or 0.8 log 2, or 1.0 log, higher cleavage efficiency in an in vitro biochemical competitive assay compared to the cleavage by the same protease of a control sequence RSR-1517 having the sequence EAGRSANHEP-LGLVAT (SEQ ID NO: 7001). In some embodiments, the disclosure provides an RS in which the RS is cleaved by a protease including but not limited to MMP-2, MMP-7, MMP-9, MMP-11, uPA, or matriptase with at least a 0.2 log 2, or 0.4 log 2, or 0.8 log 2, or 1.0 log 2 lower cleavage efficiency in an in vitro biochemical competitive assay compared to the cleavage by the same protease of a control sequence RSR-1517 having the sequence EAGRSANHEP- LGLVAT (SEQ ID NO: 7001). In some embodiments, the disclosure provides an RS in which the rate of cleavage of the RS by a protease including but not limited to MMP-2, MMP-7, MMP-9, MMP-14, uPA, or matriptase is at least 2-fold, or at least 4-fold, or at least 8 fold, or at least 16-fold faster compared to the control sequence RSR-1517 having the sequence EAGRSANHEPLGLVAT (SEQ ID NO: 7001). In some embodiments, the disclosure provides an RS in which the rate of cleavage of the RS by a protease including but not limited to MMP-2, MMP-7, MMP-9, MMP-14, uPA, or matriptase is at least 2-fold, or at least 4-fold, or at least 8-fold, or at least 16-fold slower compared to the control sequence RSR-1517 having the sequence EAGRSANHEP- LGLVAT (SEQ ID NO: 7001).

In some embodiments, the RS comprises the amino acid sequence EAGRSAXHTPAGLTGP (SEQ ID NO: 7627), wherein X is any amino acid other than N. In some embodiments, X is S. In some embodiments, X is T. In some embodiments, X is Y. In some embodiments, X is Q. In some embodiments, X is G. In some embodiments, X is A. In some embodiments, X is V. In some embodiments, X is C. In some embodiments, X is P. In some embodiments, X is L. In some embodiments, X is I. In some embodiments, X is M. In some embodiments, X is F. In some embodiments, X is K. In some embodiments, X is R. In some embodiments, X is H. In some embodiments, X is D. In some embodiments, X is E. In some embodiments, the RS is not cleaved by legumain. In some embodiments, the RS is not cleavable by legumain in human blood, plasma, or serum.

In some embodiments, the RS is not cleavable upon incubation with about 1 nM or less legumain for about 20 hours. In some embodiments, the RS is cleaved by legumain less quickly or efficiently than RSR-2295 (EAGRSANHT- PAGLTGP) (SEQ ID NO:7048) is cleaved by legumain. In some embodiments, the RS is cleaved by legumain at a rate that is less than about 50% of the rate that legumain cleaves RSR-2295 (EAGRSANHTPAGLTGP) (SEQ ID NO:7048). In some embodiments, the RS is cleaved by legumain at a rate that is less than about 25% of the rate that legumain cleaves RSR-2295. In some embodiments, the RS is cleaved by legumain at a rate that is less than about 10% of the rate that legumain cleaves RSR-2295. In some embodiments, the RS is cleaved by legumain at a rate that is less than about 5% of the rate that legumain cleaves RSR-2295. In some embodiments, the RS is cleaved by legumain at a rate that is less than about 2.5% of the rate that legumain cleaves RSR-2295.

In some embodiments, the RS is cleaved by legumain at a rate that is less than about 50% of the rate that legumain cleaves RSR-2295 (EAGRSANHTPAGLTGP) (SEQ ID NO:7048) in human plasma. In some embodiments, the RS is cleaved by legumain at a rate that is less than about 25% of the rate that legumain cleaves RSR-2295 in human plasma. In some embodiments, the RS is cleaved by legu- main at a rate that is less than about 10% of the rate that legumain cleaves RSR-2295 in human plasma. In some embodiments, the RS is cleaved by legumain at a rate that is less than about 5% of the rate that legumain cleaves RSR-2295 in human plasma. In some embodiments, the RS is cleaved by legumain at a rate that is less than about 2.5% of the rate that legumain cleaves RSR-2295 in human plasma.

In some embodiments, the disclosure provides paTCEs comprising multiple RSs wherein each RS sequence is identified herein by the group of sequences set forth in Table 7a and the RSs are linked to each other by 1 to 6 amino acids that are glycine, serine, alanine, and threonine. In some embodiments, a paTCE comprises a first RS and a second RS different from the first RS wherein each RS sequence is identified herein by a sequence set forth in Table 7a and the RSs are linked to each other by 1 to 6 amino acids that are glycine, serine, alanine, and threonine. In some embodi- ments, the paTCE comprises a first RS, a second RS different from the first RS, and a third RS different from the first and the second RS wherein each sequence is identified herein by's sequence set forth in Table 7a and the first and the second and the third RS are linked to each other by 1 to 6 amino acids that are glycine, serine, alanine, and threo- nine. In some embodiments, multiple RS of the paTCE can be concatenated to form a sequence that can be cleaved by multiple proteases at different rates or efficiency of cleavage. In some embodiments, the disclosure provides a paTCE comprising an RS1 and an RS2, wherein each has a sequences set forth in Table 7a or 7b and ELNNs (e.g., an ELNN1 and ELNN2), such as those described herein, wherein the RS1 is fused between the ELNN1 and the binding moieties and the RS2 is fused between the ELNN2 and the binding moieties. In some embodiments, a paTCE is more readily cleaved in target tissues that express multiple proteases (e.g., tumor tissues), compared with healthy tis- sues or when in the normal circulation, with the result that the resulting fragments bearing the binding moieties would more readily penetrate the target tissue; e.g., a tumor, and have an enhanced ability to bind and link the cancer cell and the effector cell.

In some embodiments, a paTCE comprises a first release segment (RS1) positioned between a first ELNN a bispecific antibody. In some embodiments, the polypeptide further comprises a second release segment (RS2) positioned between the bispecific antibody and a second ELNN. In some embodiments, RS1 and RS2 are identical in sequence. In some embodiments, RS1 and RS2 are not identical in sequence. In some embodiments, the RS1 comprises an amino acid sequence having at least 85%, 90%, 91%, 92%, 93%, 94%, 95%, 96%, 97%, 98%, 99% or 100% sequence identity to a sequence identified herein in Table 7a or 7b or a subset thereof. In some embodiments, the RS2 comprises an amino acid sequence having at least 85%, 90%, 91%, 92%, 93%, 94%, 95%, 96%, 97%, 98%, 99% or 100% sequence identity to a sequence identified herein in Table 7a or 7b or a subset thereof. In some embodiments, the RS1 and RS2 are each a substrate for cleavage by multiple proteases at one, two, or three cleavage sites within each release segment sequence.

In some embodiments, the paTCE further comprises one or more reference fragments (e.g., barcode fragments) releasable from the paTCE upon digestion by the protease. In some embodiments, the one or more reference fragments is a single reference fragment that differs in sequence and molecular weight from all other peptide fragments that are releasable from the polypeptide upon digestion of the poly- peptide by the protease.

Exemplary paTCEs

In some embodiments, a paTCE comprises an amino acid sequence having at least (about) 80% sequence identity to a sequence set forth in Table D (SEQ ID NOs: 1000-1007) or a subset thereof. In some embodiments, the paTCE com- prises an amino acid sequence having at least (about) 81%, at least (about) 82%, at least (about) 83%, at least (about)

84%, at least (about) 85%, at least (about) 86%, at least (about) 87%, at least (about) 88%, at least (about) 89%, at least (about) 90%, at least (about) 91%, at least (about) 92%, at least (about) 93%, at least (about) 94%, at least (about) 95%, at least (about) 96%, at least (about) 97%, at least (about) 98%, at least (about) 99%, or (about) 100% sequence identity to a sequence set forth in SEQ ID NOs: 1000-1007 or a subset thereof. In some embodiments, the paTCE comprises an amino acid sequence having at least (about) 90%, at least (about) 91%, at least (about) 92%, at least (about) 93%, at least (about) 94%, at least (about) 95%, at least (about) 96%, at least (about) 97%, at least (about)

98%, at least (about) 99%, or (about) 100% sequence identity to a sequence set forth in SEQ ID NOs: 1000-1007 or a subset thereof. In some embodiments, the paTCE comprises an amino acid sequence identical to a sequence set forth in SEQ ID NOs: 1000-1007. It is specifically contemplated that the compositions of this disclosure can comprise sequence variants of the amino acid sequences set forth in Table D, such as with linker sequence(s) substituted or inserted or with purification tag sequence(s) attached thereto, so long as the variants exhibit substantially similar or same bioactivity/bioactivities and/or activation mechanism(s).

TABLE D

| Exemplary amino acid sequences of polypeptides | |
| --- | --- |
| SEQ ID NO | AMINO ACID SEQUENCE |
| 1000 (AMX-525) | ASSATPESGPGTSTEPSEGSAPGTSESATPESGPGSGPGTSESATPGTSESATPESGPGS EPATSGSETPGTSESATPESGPGTSTEPSEGSAPGSPAGSPTSTEEGTSESATPESGPGS EPATSGSETPGTSESATPESGPGSPAGSPTSTEEGSPAGSPTSTEEGTSTEPSEGSAPGT SESATPESGPGTSESATPESGPGTSESATPESGPGSEPATSGSETPGSEPATSGSETPGS PAGSPTSTEEGTSTEPSEGSAPGTSTEPSEGSAPGSEPATSGSETPGTSESATPEAGRSA SHTPAGLTGPGTSESATPESDIQMTQSPSSLSASVGDRVTITCQASQDISNYLNWYQQ KPGKAPKLLIYDASNLETGVPSRFSGSGSGTDFTFTISSLQPEDIATYYCQHFDHLPLA FGQGTKVEIKSESATPESGPGTSPGATPESGPGTSESATPQVQLQESGPGLVKPSETLS LTCTVSGGSVSSGDYYWTWIRQPPGKGLEWIGHIYYSGNTNYNPSLKSRVTISVDTS KNQFSLKLSSVTAADTAVYYCARDRVTGAFDIWGQGTLVTVSSGGGGSELVVTQEP SLTVSPGGTVTLTCRSSNGAVTSSNYANWVQQKPGQAPRGLIGGTNKRAPGTPARFS GSLLEGKAALTLSGVQPEDEAVYYCALWYPNLWVFGGGTKLTVLSESATPESGPGT SPGATPESGPGTSESATPEVQLVESGGGIVQPGGSLRLSCAASGFTFSTYAMNWVRQ APGKGLEWVGRIRTKRNDYATYYADSVKGRFTISRDDSKNTLYLQMNSLKTEDTAV YYCVRHENFGNSYVSWFAHWGQGTLVTVSSGTATPESGPGEAGRSASHTPAGLTGP ATPESGPGTSESATPESGPGSPAGSPTSTEEGTSESATPESGPGSEPATSGSETPGTSES ATPESGPGTSTEPSEGSAPGTSTEPSEGSAPGTSTEPSEGSAPGTSTEPSEGSAPGTSTE PSEGSAPGTSTEPSEGSAPGSPAGSPTSTEEGTSTEPSEGSAPGTSESATPESGPGSEPA TSGSETPGTSESATPESGPGSEPATSGSETPGTSESATPESGPGTSTEPSEGSAPGTSES ATPESGPGSPAGSPTSTEEGSPAGSPTSTEEGSPAGSPTSTEEGTSESATPESGPGTSTE PSEGSAPGTSESATPESGPGSEPATSGSETPGTSESATPESGPGSEPATSGSETPGTSES ATPESGPGTSTEPSEGSAPGSPAGSPTSTEEGTSESATPESGPGSEPATSGSETPGTSES ATPESGPGSPAGSPTSTEEGSPAGSPTSTEEGTSTEPSEGSAPGTSESATPESGPGTSES ATPESGPGTSPSATPESGPGSEPATSGSETPGSEPATSGSETPGSPAGSPTSTEEGTSTE PSEGSAPGTSTEPSEGSAPGSEPATSGSETPGTSESAGEPEA |
| 1001 | ASSATPESGPGTSTEPSEGSAPGTSESATPESGPGSGPGTSESATPGTSESATPESGPGS EPATSGSETPGTSESATPESGPGTSTEPSEGSAPGSPAGSPTSTEEGTSESATPESGPGS EPATSGSETPGTSESATPESGPGSPAGSPTSTEEGSPAGSPTSTEEGTSTEPSEGSAPGT SESATPESGPGTSESATPESGPGTSESATPESGPGSEPATSGSETPGSEPATSGSETPGS PAGSPTSTEEGTSTEPSEGSAPGTSTEPSEGSAPGSEPATSGSETPGTSESATPEAGRSA SHTPAGLTGPGTSESATPESDIQMTQSPSSLSASVGDRVTITCQASQDISNYLNWYQQ KPGKAPKLLIYDASNLETGVPSRFSGSGSGTDFTFTISSLQPEDIATYYCQHFDHLPLA FGQGTKVEIKSESATPESGPGTSPGATPESGPGTSESATPQVQLQQWGAGLLKPSETL SLTCAVYGGSVSSGDYYWTWIRQPPGKGLEWIGHIYYSGNTNYNPSLKSRVTISVDT SKNQFSLKLSSVTAADTAVYYCARDRVTGAFDIWGQGTLVTVSSGGGGSELVVTQE PSLTVSPGGTVTLTCRSSNGAVTSSNYANWVQQKPGQAPRGLIGGTNKRAPGTPARF SGSLLEGKAALTLSGVQPEDEAVYYCALWYPNLWVFGGGTKLTVLSESATPESGPG TSPGATPESGPGTSESATPEVQLVESGGGIVQPGGSLRLSCAASGFTFSTYAMNWVR QAPGKGLEWVGRIRTKRNDYATYYADSVKGRFTISRDDSKNTLYLQMNSLKTEDTA VYYCVRHENFGNSYVSWFAHWGQGTLVTVSSGTATPESGPGEAGRSASHTPAGLT GPATPESGPGTSESATPESGPGSPAGSPTSTEEGTSESATPESGPGSEPATSGSETPGTS ESATPESGPGTSTEPSEGSAPGTSTEPSEGSAPGTSTEPSEGSAPGTSTEPSEGSAPGTS TEPSEGSAPGTSTEPSEGSAPGSPAGSPTSTEEGTSTEPSEGSAPGTSESATPESGPGSE PATSGSETPGTSESATPESGPGSEPATSGSETPGTSESATPESGPGTSTEPSEGSAPGTS ESATPESGPGSPAGSPTSTEEGSPAGSPTSTEEGSPAGSPTSTEEGTSESATPESGPGTS TEPSEGSAPGTSESATPESGPGSEPATSGSETPGTSESATPESGPGSEPATSGSETPGTS ESATPESGPGTSTEPSEGSAPGSPAGSPTSTEEGTSESATPESGPGSEPATSGSETPGTS ESATPESGPGSPAGSPTSTEEGSPAGSPTSTEEGTSTEPSEGSAPGTSESATPESGPGTS ESATPESGPGTSPSATPESGPGSEPATSGSETPGSEPATSGSETPGSPAGSPTSTEEGTS TEPSEGSAPGTSTEPSEGSAPGSEPATSGSETPGTSESAGEPEA |
| 1002 | ASSATPESGPGTSTEPSEGSAPGTSESATPESGPGSGPGTSESATPGTSESATPESGPGS EPATSGSETPGTSESATPESGPGTSTEPSEGSAPGSPAGSPTSTEEGTSESATPESGPGS EPATSGSETPGTSESATPESGPGSPAGSPTSTEEGSPAGSPTSTEEGTSTEPSEGSAPGT SESATPESGPGTSESATPESGPGTSESATPESGPGSEPATSGSETPGSEPATSGSETPGS PAGSPTSTEEGTSTEPSEGSAPGTSTEPSEGSAPGSEPATSGSETPGTSESATPEAGRSA SHTPAGLTGPGTSESATPESDIQMTQSPSSLSASVGDRVTITCQASQDISNYLNWYQQ KPGKAPKLLIYDASNLETGVPSRFSGSGSGTDFTLTISSLQPEDFATYYCQHFDHLPL |

TABLE D-continued

Exemplary amino acid sequences of polypeptides

| SEQ ID NO | AMINO ACID SEQUENCE |
|---|---|

AFGQGTKVEIKSESATPESGPGTSPGATPESGPGTSESATPQVQLQQWGAGLLKPSET
LSLTCAVYGGSVSSGDYYWTWIRQPPGKGLEWIGHIYYSGNTNYNPSLKSRVTISVD
TSKNQFSLKLSSVTAADTAVYYCARDRVTGAFDIWGQGTLVTVSSGGGGSELVVTQ
EPSLTVSPGGTVTLTCRSSNGAVTSSNYANWVQQKPGQAPRGLIGGTNKRAPGTPA
RFSGSLLEGKAALTLSGVQPEDEAVYYCALWYPNLWVFGGGTKLTVLSESATPESG
PGTSPGATPESGPGTSESATPEVQLVESGGGIVQPGGSLRLSCAASGFTFSTYAMNW
VRQAPGKGLEWVGRIRTKRNDYATYYADSVKGRFTISRDDSKNTLYLQMNSLKTE
DTAVYYCVRHENFGNSYVSWFAHWGQGTLVTVSSGTATPESGPGEAGRSASHTPA
GLTGPATPESGPGTSESATPESGPGSPAGSPTSTEEGTSESATPESGPGSEPATSGSETP
GTSESATPESGPGTSTEPSEGSAPGTSTEPSEGSAPGTSTEPSEGSAPGTSTEPSEGSAP
GTSTEPSEGSAPGTSTEPSEGSAPGSPAGSPTSTEEGTSTEPSEGSAPGTSESATPESGP
GSEPATSGSETPGTSESATPESGPGSEPATSGSETPGTSESATPESGPGTSTEPSEGSAP
GTSESATPESGPGSPAGSPTSTEEGSPAGSPTSTEEGSPAGSPTSTEEGTSESATPESGP
GTSTEPSEGSAPGTSESATPESGPGSEPATSGSETPGTSESATPESGPGSEPATSGSETP
GTSESATPESGPGTSTEPSEGSAPGSPAGSPTSTEEGTSESATPESGPGSEPATSGSETP
GTSESATPESGPGSPAGSPTSTEEGSPAGSPTSTEEGTSTEPSEGSAPGTSESATPESGP
GTSESATPESGPGTSPSATPESGPGSEPATSGSETPGSEPATSGSETPGSPAGSPTSTEE
GTSTEPSEGSAPGTSTEPSEGSAPGSEPATSGSETPGTSESAGEPEA

| 1003 | ASSATPESGPGTSTEPSEGSAPGTSESATPESGPGSGPGTSESATPGTSESATPESGPGS |
|---|---|

EPATSGSETPGTSESATPESGPGTSTEPSEGSAPGSPAGSPTSTEEGTSESATPESGPGS
EPATSGSETPGTSESATPESGPGSPAGSPTSTEEGSPAGSPTSTEEGTSTEPSEGSAPGT
SESATPESGPGTSESATPESGPGTSESATPESGPGSEPATSGSETPGSEPATSGSETPGS
PAGSPTSTEEGTSTEPSEGSAPGTSTEPSEGSAPGSEPATSGSETPGTSESATPEAGRSA
SHTPAGLTGPGTSESATPESDIQMTQSPSSLSASVGDRVTITCQASQDISNYLNWYQQ
KPGKAPKLLIYDASNLETGVPSRFSGSGSGTDFTLTISSLQPEDFATYYCQHFDHLPL
AFGQGTKVEIKSESATPESGPGTSPGATPESGPGTSESATPQVQLQESGPGLVKPSETL
SLTCTVSGGSVSSGDYYWTWIRQPPGKGLEWIGHIYYSGNTNYNPSLKSRVTISVDT
SKNQFSLKLSSVTAADTAVYYCARDRVTGAFDIWGQGTLVTVSSGGGGSELVVTQE
PSLTVSPGGTVTLTCRSSNGAVTSSNYANWVQQKPGQAPRGLIGGTNKRAPGTPARF
SGSLLEGKAALTLSGVQPEDEAVYYCALWYPNLWVFGGGTKLTVLSESATPESGPG
TSPGATPESGPGTSESATPEVQLVESGGGIVQPGGSLRLSCAASGFTFSTYAMNWVR
QAPGKGLEWVGRIRTKRNDYATYYADSVKGRFTISRDDSKNTLYLQMNSLKTEDTA
VYYCVRHENFGNSYVSWFAHWGQGTLVTVSSGTATPESGPGEAGRSASHTPAGLT
GPATPESGPGTSESATPESGPGSPAGSPTSTEEGTSESATPESGPGSEPATSGSETPGTS
ESATPESGPGTSTEPSEGSAPGTSTEPSEGSAPGTSTEPSEGSAPGTSTEPSEGSAPGTS
TEPSEGSAPGTSTEPSEGSAPGSPAGSPTSTEEGTSTEPSEGSAPGTSESATPESGPGSE
PATSGSETPGTSESATPESGPGSEPATSGSETPGTSESATPESGPGTSTEPSEGSAPGTS
ESATPESGPGSPAGSPTSTEEGSPAGSPTSTEEGSPAGSPTSTEEGTSESATPESGPGTS
TEPSEGSAPGTSESATPESGPGSEPATSGSETPGTSESATPESGPGSEPATSGSETPGTS
ESATPESGPGTSTEPSEGSAPGSPAGSPTSTEEGTSESATPESGPGSEPATSGSETPGTS
ESATPESGPGSPAGSPTSTEEGSPAGSPTSTEEGTSTEPSEGSAPGTSESATPESGPGTS
ESATPESGPGTSPSATPESGPGSEPATSGSETPGSEPATSGSETPGSPAGSPTSTEEGTS
TEPSEGSAPGTSTEPSEGSAPGSEPATSGSETPGTSESAGEPEA

| 1004 | ASSATPESGPGTSTEPSEGSAPGTSESATPESGPGSGPGTSESATPGTSESATPESGPGS |
|---|---|

EPATSGSETPGTSESATPESGPGTSTEPSEGSAPGSPAGSPTSTEEGTSESATPESGPGS
EPATSGSETPGTSESATPESGPGSPAGSPTSTEEGSPAGSPTSTEEGTSTEPSEGSAPGT
SESATPESGPGTSESATPESGPGTSESATPESGPGSEPATSGSETPGSEPATSGSETPGS
PAGSPTSTEEGTSTEPSEGSAPGTSTEPSEGSAPGSEPATSGSETPGTSESATPEAGRSA
SHTPAGLTGPGTSESATPESEIVLTQSPGTLSLSPGERATLSCQASQDISNYLNWYQQ
KPGQAPRLLIYDASNLETGIPDRFSGSGSGTDFTLTISRLEPEDFAVYYCQHFDHLPLA
FGQGTKVEIKSESATPESGPGTSPGATPESGPGTSESATPQVQLQQWGAGLLKPSETL
SLTCAVYGGSVSSGDYYWTWIRQPPGKGLEWIGHIYYSGNTNYNPSLKSRVTISVDT
SKNQFSLKLSSVTAADTAVYYCARDRVTGAFDIWGQGTLVTVSSGGGGSELVVTQE
PSLTVSPGGTVTLTCRSSNGAVTSSNYANWVQQKPGQAPRGLIGGTNKRAPGTPARF
SGSLLEGKAALTLSGVQPEDEAVYYCALWYPNLWVFGGGTKLTVLSESATPESGPG
TSPGATPESGPGTSESATPEVQLVESGGGIVQPGGSLRLSCAASGFTFSTYAMNWVR
QAPGKGLEWVGRIRTKRNDYATYYADSVKGRFTISRDDSKNTLYLQMNSLKTEDTA
VYYCVRHENFGNSYVSWFAHWGQGTLVTVSSGTATPESGPGEAGRSASHTPAGLT
GPATPESGPGTSESATPESGPGSPAGSPTSTEEGTSESATPESGPGSEPATSGSETPGTS
ESATPESGPGTSTEPSEGSAPGTSTEPSEGSAPGTSTEPSEGSAPGTSTEPSEGSAPGTS
TEPSEGSAPGTSTEPSEGSAPGSPAGSPTSTEEGTSTEPSEGSAPGTSESATPESGPGSE
PATSGSETPGTSESATPESGPGSEPATSGSETPGTSESATPESGPGTSTEPSEGSAPGTS
ESATPESGPGSPAGSPTSTEEGSPAGSPTSTEEGSPAGSPTSTEEGTSESATPESGPGTS
TEPSEGSAPGTSESATPESGPGSEPATSGSETPGTSESATPESGPGSEPATSGSETPGTS
ESATPESGPGTSTEPSEGSAPGSPAGSPTSTEEGTSESATPESGPGSEPATSGSETPGTS
ESATPESGPGSPAGSPTSTEEGSPAGSPTSTEEGTSTEPSEGSAPGTSESATPESGPGTS
ESATPESGPGTSPSATPESGPGSEPATSGSETPGSEPATSGSETPGSPAGSPTSTEEGTS
TEPSEGSAPGTSTEPSEGSAPGSEPATSGSETPGTSESAGEPEA

| 1005 | ASSATPESGPGTSTEPSEGSAPGTSESATPESGPGSGPGTSESATPGTSESATPESGPGS |
|---|---|

EPATSGSETPGTSESATPESGPGTSTEPSEGSAPGSPAGSPTSTEEGTSESATPESGPGS
EPATSGSETPGTSESATPESGPGSPAGSPTSTEEGSPAGSPTSTEEGTSTEPSEGSAPGT
SESATPESGPGTSESATPESGPGTSESATPESGPGSEPATSGSETPGSEPATSGSETPGS

TABLE D-continued

Exemplary amino acid sequences of polypeptides

SEQ ID
NO        AMINO ACID SEQUENCE

PAGSPTSTEEGTSTEPSEGSAPGTSTEPSEGSAPGSEPATSGSETPGTSESATPEAGRSA
SHTPAGLTGPGTSESATPESEIVLTQSPGTLSLSPGERATLSCQASQDISNYLNWYQQ
KPGQAPRLLIYDASNLETGIPDRFSGSGSGTDFTLTISRLEPEDFAVYYCQHFDHLPLA
FGQGTKVEIKSESATPESGPGSPGATPESGPGTSESATPQVQLQESGPGLVKPSETLS
LTCTVSGGSVSSGDYYWTWIRQPPGKGLEWIGHIYYSGNTNYNPSLKSRVTISVDTS
KNQFSLKLSSVTAADTAVYYCARDRVTGAFDIWGQGTLVTVSSGGGGSELVVTQEP
SLTVSPGGTVTLTCRSSNGAVTSSNYANWVQQKPGQAPRGLIGGTNKRAPGTPARFS
GSLLEGKAALTLSGVQPEDEAVYYCALWYPNLWVFGGGTKLTVLSESATPESGPGT
SPGATPESGPGTSESATPEVQLVESGGGIVQPGGSLRLSCAASGFTFSTYAMNWVRQ
APGKGLEWVGRIRTKRNDYATYYADSVKGRFTISRDDSKNTLYLQMNSLKTEDTAV
YYCVRHENFGNSYVSWFAHWGQGTLVTVSSGTATPESGPGEAGRSASHTPAGLTGP
ATPESGPGTSESATPESGPGSPAGSPTSTEEGTSESATPESGPGSEPATSGSETPGTSES
ATPESGPGTSTEPSEGSAPGTSTEPSEGSAPGTSTEPSEGSAPGTSTEPSEGSAPGTSTE
PSEGSAPGTSTEPSEGSAPGSPAGSPTSTEEGTSTEPSEGSAPGTSESATPESGPGSEPA
TSGSETPGTSESATPESGPGSEPATSGSETPGTSESATPESGPGSEPATSGSETPGTSES
ATPESGPGSPAGSPTSTEEGSPAGSPTSTEEGSPAGSPTSTEEGTSESATPESGPGTSTE
PSEGSAPGSEPATSGSETPGTSESATPESGPGSEPATSGSETPGTSES
ATPESGPGTSTEPSEGSAPGSPAGSPTSTEEGTSESATPESGPGSEPATSGSETPGTSES
ATPESGPGSPAGSPTSTEEGSPAGSPTSTEEGTSTEPSEGSAPGTSESATPESGPGTSES
ATPESGPGTSPSATPESGPGSEPATSGSETPGSEPATSGSETPGSPAGSPTSTEEGTSTE
PSEGSAPGTSTEPSEGSAPGSEPATSGSETPGTSESAGEPEA

1006      ASSATPESGPGTSTEPSEGSAPGTSESATPESGPGSGPGTSESATPGTSESATPESGPGS
EPATSGSETPGTSESATPESGPGTSTEPSEGSAPGSPAGSPTSTEEGTSESATPESGPGS
EPATSGSETPGTSESATPESGPGSPAGSPTSTEEGSPAGSPTSTEEGTSTEPSEGSAPGT
SESATPESGPGTSESATPESGPGTSESATPESGPGSEPATSGSETPGSEPATSGSETPGS
PAGSPTSTEEGTSTEPSEGSAPGTSTEPSEGSAPGSEPATSGSETPGTSESATPEAGRSA
SHTPAGLTGPGTSESATPESEIVLTQSPATLSLSPGERATLSCQASQDISNYLNWYQQ
KPGQAPRLLIYDASNLETGIPARFSGSGSGTDFTLTISSLEPEDFAVYYCQHFDHLPLA
FGQGTKVEIKSESATPESGPGSPGATPESGPGTSESATPQVQLQQWGAGLLKPSETL
SLTCAVYGGSVSSGDYYWTWIRQPPGKGLEWIGHIYYSGNTNYNPSLKSRVTISVDT
SKNQFSLKLSSVTAADTAVYYCARDRVTGAFDIWGQGTLVTVSSGGGGSELVVTQE
PSLTVSPGGTVTLTCRSSNGAVTSSNYANWVQQKPGQAPRGLIGGTNKRAPGTPARF
SGSLLEGKAALTLSGVQPEDEAVYYCALWYPNLWVFGGGTKLTVLSESATPESGPG
TSPGATPESGPGTSESATPEVQLVESGGGIVQPGGSLRLSCAASGFTFSTYAMNWVR
QAPGKGLEWVGRIRTKRNDYATYYADSVKGRFTISRDDSKNTLYLQMNSLKTEDTA
VYYCVRHENFGNSYVSWFAHWGQGTLVTVSSGTATPESGPGEAGRSASHTPAGLT
GPATPESGPGTSESATPESGPGSPAGSPTSTEEGTSESATPESGPGSEPATSGSETPGTS
ESATPESGPGTSTEPSEGSAPGTSTEPSEGSAPGTSTEPSEGSAPGTSTEPSEGSAPGTS
TEPSEGSAPGTSTEPSEGSAPGSPAGSPTSTEEGTSTEPSEGSAPGTSESATPESGPGSE
PATSGSETPGTSESATPESGPGSEPATSGSETPGTSESATPESGPGTSTEPSEGSAPGTS
ESATPESGPGSPAGSPTSTEEGSPAGSPTSTEEGSPAGSPTSTEEGTSESATPESGPGTS
TEPSEGSAPGTSESATPESGPGSEPATSGSETPGTSESATPESGPGSEPATSGSETPGTS
ESATPESGPGTSTEPSEGSAPGSPAGSPTSTEEGTSESATPESGPGSEPATSGSETPGTS
ESATPESGPGSPAGSPTSTEEGSPAGSPTSTEEGTSTEPSEGSAPGTSESATPESGPGTS
ESATPESGPGTSPSATPESGPGSEPATSGSETPGSEPATSGSETPGSPAGSPTSTEEGTS
TEPSEGSAPGTSTEPSEGSAPGSEPATSGSETPGTSESAGEPEA

1007      ASSATPESGPGTSTEPSEGSAPGTSESATPESGPGSGPGTSESATPGTSESATPESGPGS
EPATSGSETPGTSESATPESGPGTSTEPSEGSAPGSPAGSPTSTEEGTSESATPESGPGS
EPATSGSETPGTSESATPESGPGSPAGSPTSTEEGSPAGSPTSTEEGTSTEPSEGSAPGT
SESATPESGPGTSESATPESGPGTSESATPESGPGSEPATSGSETPGSEPATSGSETPGS
PAGSPTSTEEGTSTEPSEGSAPGTSTEPSEGSAPGSEPATSGSETPGTSESATPEAGRSA
SHTPAGLTGPGTSESATPESEIVLTQSPATLSLSPGERATLSCQASQDISNYLNWYQQ
KPGQAPRLLIYDASNLETGIPARFSGSGSGTDFTLTISSLEPEDFAVYYCQHFDHLPLA
FGQGTKVEIKSESATPESGPGTSPGATPESGPGTSESATPQVQLQESGPGLVKPSETLS
LTCTVSGGSVSSGDYYWTWIRQPPGKGLEWIGHIYYSGNTNYNPSLKSRVTISVDTS
KNQFSLKLSSVTAADTAVYYCARDRVTGAFDIWGQGTLVTVSSGGGGSELVVTQEP
SLTVSPGGTVTLTCRSSNGAVTSSNYANWVQQKPGQAPRGLIGGTNKRAPGTPARFS
GSLLEGKAALTLSGVQPEDEAVYYCALWYPNLWVFGGGTKLTVLSESATPESGPGT
SPGATPESGPGTSESATPEVQLVESGGGIVQPGGSLRLSCAASGFTFSTYAMNWVRQ
APGKGLEWVGRIRTKRNDYATYYADSVKGRFTISRDDSKNTLYLQMNSLKTEDTAV
YYCVRHENFGNSYVSWFAHWGQGTLVTVSSGTATPESGPGEAGRSASHTPAGLTGP
ATPESGPGTSESATPESGPGSPAGSPTSTEEGTSESATPESGPGSEPATSGSETPGTSES
ATPESGPGTSTEPSEGSAPGTSTEPSEGSAPGTSTEPSEGSAPGTSTEPSEGSAPGTSTE
PSEGSAPGTSTEPSEGSAPGSPAGSPTSTEEGTSTEPSEGSAPGTSESATPESGPGSEPA
TSGSETPGTSESATPESGPGSEPATSGSETPGTSESATPESGPGTSTEPSEGSAPGTSES
ATPESGPGSPAGSPTSTEEGSPAGSPTSTEEGSPAGSPTSTEEGTSESATPESGPGTSTE
PSEGSAPGTSESATPESGPGSEPATSGSETPGTSESATPESGPGSEPATSGSETPGTSES
ATPESGPGTSTEPSEGSAPGSPAGSPTSTEEGTSESATPESGPGSEPATSGSETPGTSES
ATPESGPGSPAGSPTSTEEGSPAGSPTSTEEGTSTEPSEGSAPGTSESATPESGPGTSES
ATPESGPGTSPSATPESGPGSEPATSGSETPGSEPATSGSETPGSPAGSPTSTEEGTSTE
PSEGSAPGTSTEPSEGSAPGSEPATSGSETPGTSESAGEPEA

Recombinant Production

Also provided are polynucleotides that encode any polypeptide disclosed herein and/or the reverse complements of such polynucleotides.

The disclosure herein includes an expression vector that comprises a polynucleotide sequence, such as any described in the preceding paragraph, and a regulatory sequence operably linked to the polynucleotide sequence.

The disclosure herein includes a host cell comprising an expression vector, such as described any in the preceding paragraph. In some embodiments, the host cell is a prokaryote. In some embodiments, the host cell is *E. coli*. In some embodiments, the host cell is a mammalian cell.

In some embodiments, the disclosure provides methods of manufacturing the subject compositions. In some embodiments, such a method comprises culturing a host cell comprising a nucleic acid construct that encodes a polypeptide (such as a paTCE) described herein under conditions that promote the expression of the polypeptide, followed by recovery of the polypeptide using standard purification methods (e.g., column chromatography, HPLC, and the like) wherein the composition is recovered wherein at least 70%, or at least 80%, or at least 90%, or at least 95%, or at least 97%, or at least 99% of the binding fragments of the expressed polypeptide or paTCE fusion polypeptide are correctly folded. In some embodiments of the method of making, the expressed polypeptide is recovered in which at least or at least 90%, or at least 95%, or at least 97%, or at least 99% of the polypeptide is recovered in monomeric, soluble form.

In some embodiments, the disclosure relates to methods of making a polypeptide (such as a paTCE fusion polypeptide) at high fermentation expression levels of functional protein using an *E. coli* or mammalian host cell, as well as providing expression vectors encoding the polypeptides useful in methods to produce the cytotoxically active polypeptide compositions at high expression levels. In some embodiments, the method comprises the steps of 1) preparing a polynucleotide encoding a polypeptide disclosed herein, 2) cloning the polynucleotide into an expression vector, which can be a plasmid or other vector under the control of appropriate transcription and translation sequences for high level protein expression in a biological system, 3) transforming an appropriate host cell with the expression vector, and 4) culturing the host cell in conventional nutrient media under conditions suitable for the expression of the polypeptide composition. Where desired, the host cell is *E. coli*. As used herein, the term "correctly folded" means that the antigen binding fragments component of the composition have the ability to specifically bind their target ligands (e.g., upon activation). In some embodiments, the disclosure provides a method for producing a polypeptide, the method comprising culturing in a fermentation reaction a host cell that comprises a vector encoding a polypeptide comprising the polypeptide under conditions effective to express the polypeptide product.

Pharmaceutical Composition

Disclosed herein includes a pharmaceutical composition comprising a polypeptide (such as a paTCE), such as any described herein, and one or more pharmaceutically acceptable excipients. In some embodiments, the pharmaceutical composition is formulated for intradermal, subcutaneous, intravenous, intra-arterial, intraabdominal, intraperitoneal, intravitreal, intrathecal, or intramuscular administration. In some embodiments, the pharmaceutical composition is formulated for intravenous injection. In some embodiments, the pharmaceutical composition is in a liquid form or frozen. In some embodiments, the pharmaceutical composition is formulated as a lyophilized powder to be reconstituted prior to administration.

The pharmaceutical compositions can be administered for therapy by any suitable route. In some embodiments, the dose is administered intradermally, subcutaneously, intravenously, intra-arterially, intra-abdominally, intraperitoneally, intrathecally, or intramuscularly. In some embodiments, the subject is a mouse, rat, monkey, or human. In preferred embodiments, the subject is a human.

In some embodiments, the pharmaceutical composition can be administered subcutaneously, intramuscularly, or intravenously. In some embodiments, the pharmaceutical composition is administered at a therapeutically effective amount. In some embodiments, the therapeutically effective amount results in a gain in time spent within a therapeutic window for the fusion protein compared to the corresponding TCE of the fusion protein not linked to the ELNN and administered at a comparable dose to a subject.

In some embodiments, the pharmaceutical composition is administered subcutaneously. In some embodiments, the pharmaceutical composition is administered intravenously.

In some embodiments, the composition may be supplied as a lyophilized powder or cake to be reconstituted prior to administration. In some embodiments, the composition may also be supplied in a liquid form or frozen, which can be administered directly to a subject.

Pharmaceutical Kits

In some embodiments, the present disclosure provides kits to facilitate the use of paTCEs. In some embodiments, a kit comprises (a) a first container comprising pharmaceutically effective amount of a paTCE in a lyophilized composition; and (b) a second container comprising a diluent for reconstituting the lyophilized formulation. In some embodiments, the kit further comprises instructions for storage of the kit, information regarding a cancer that is treatable with the paTCE, instructions for the reconstitution of the lyophilized formulation, and/or administration instructions.

Methods of Treatment

Disclosed herein are uses of a polypeptide, such as any described herein, in the preparation of a medicament for the treatment of a disease in a subject. In some embodiments, the particular disease to be treated will depend on the choice of the biologically active proteins. In some embodiments, the disease is cancer. Included herein are paTCE polypeptides for use in the treatment of cancer. In some cases, the cancer or tumor expresses EGFR. In some embodiments, the cancer or tumor is a solid tumor. In some embodiments, the cancer is a carcinoma, a sarcoma, or a melanoma. In some embodiments, the cancer is a carcinoma. In some embodiments, the cancer is a sarcoma. In some embodiments, the cancer is a melanoma.

EGFR is one of the most frequently altered oncogenes in solid tumors. Activation of EGFR promotes processes responsible for tumor growth and progression, including proliferation and maturation, angiogenesis, invasion, metastasis, and inhibition of apoptosis. Pathological alterations of EGFR in cancers include kinase-activating mutations in EGFR and/or over-expression of the EGFR protein. Kinase-activating mutations lead to increased tyrosine kinase activity of EGFR. Over-expression of EGFR protein can be associated with or without EGFR gene amplifications. Additionally, wild-type EGFR protein is commonly over-expressed in many types of solid cancers and is often associated with negative prognosis. Alterations of EGFR in solid cancers known in the art, for example, as described in Thomas R. and Weihua Z. Front. Oncol. 9:800 (2019) and Singal et al. Cancer Control 14 (3): 295-304 (2007), each of which is incorporated herein in its entirety. Current EGFR inhibitors, including tyrosine kinase inhibitors and monoclonal antibody inhibitors, have exhibited limited efficacies and have been challenged by innate and acquired resistance in the clinic.

In some embodiments, the cancer is associated with EGFR overexpression (e.g., relative to a non-cancerous cell of the same tissue type). In some embodiments, the cancer comprises cells that express, on average, at least 3,000; 5,000; 10,000; 20,000; 30,000; 40,000; 50,000; 60,000; 70,000; 80,000; 90,000; 100,000; or 200,000 EGFR proteins per cell. In some embodiments, the cancer comprises cells having one or more oncogenic mutations in an EGFR gene. In some embodiments, the cancer comprises cells having an EGFR gene amplification. In some embodiments, the cells comprise a 2 to 5-fold, 2 to 10-fold, 2 to 15-fold, 2 to 30-fold, 2 to 50-fold, 3 to 5-fold, 3 to 10-fold, 3 to 15-fold, 3 to 30-fold, 3 to 50-fold, 5 to 10-fold, 5 to 15-fold, 5 to 30-fold, or 5 to 50-fold increase in EGFR gene copy number as compared to a non-cancerous cell of the same tissue type.

In some embodiments, the cancer is lung cancer, colorectal cancer, head and neck cancer, breast cancer, pancreatic cancer, brain cancer, liver cancer, kidney cancer, ovarian cancer, prostate cancer, esophageal cancer, cervical cancer, or bladder cancer. In some embodiments, the cancer is lung cancer. In some embodiments, the lung cancer is non-small cell lung cancer. In some embodiments, the cancer is colorectal cancer. In some embodiments, the cancer is head and neck squamous cell carcinoma. In some embodiments, the cancer is breast cancer. In some embodiments, the cancer is triple-negative breast cancer. In some embodiments, the cancer is brain cancer. In some embodiments, the brain cancer is glioblastoma.

In some embodiments, the cancer is anaplastic and medullary thyroid cancers, appendiceal cancer, arrhenoblastoma, biliary tract carcinoma, bladder cancer, breast cancer, cancers of the bile duct, carcinoid tumor, cervical cancer, cholangiocarcinoma, colon cancer, colorectal cancer, craniopharyngioma, endometrial cancer, epithelial intraperitoneal malignancy with malignant ascites, esophageal cancer. Ewing sarcoma, fallopian tube cancer, follicular cancer, gall bladder cancer, gastric cancer, gastrointestinal stromal tumor (GIST), GE-junction cancer, genito-urinary tract cancer, glioma, glioblastoma, head and neck cancer, hepatoblastoma, hepatocarcinoma, HR+ and HER2+ breast cancer, Hurthle cell cancer, Inflammatory breast cancer, Kaposi sarcoma, kidney cancer, laryngeal cancer, liposarcoma, liver cancer, lung cancer, medulloblastoma, melanoma, Merkel cell carcinoma, neuroblastoma, neuroblastoma, neuroendocrine cancer, non-small cell lung cancer, osteosarcoma (bone cancer), ovarian cancer, ovarian cancer with malignant ascites, pancreatic cancer, pancreatic neuroendocrine tumor, papillary cancer, parathyroid cancer, peritoneal carcinomatosis, peritoneal mesothelioma, primitive neuroectodermal tumor, prostate cancer, retinoblastoma, rhabdomyosarcoma, salivary gland carcinoma, sarcoma, skin cancer, small cell lung cancer, small intestine cancer, stomach cancer, testicular cancer, thyroid cancer, triple negative breast cancer, urothelial cancer, uterine cancer, uterine serous carcinoma, vaginal cancer, vulvar cancer, or Wilms tumor.

The present disclosure includes a method of treating a disease in a subject, the method comprising administering to the subject in need thereof a therapeutically effective amount of the pharmaceutical composition, such as any described herein. In some embodiments, the disease is cancer. In some embodiments, the subject is a mouse, rat, monkey, or human. In some embodiments, the subject is a human.

In some embodiments, an EGFR-targeted bispecific composition of the present disclosure (such as a paTCE) may be combined with one or more checkpoint inhibitors. In some embodiments of such combination therapy, a paTCE can be combined with an antagonist of the cell surface receptor programmed cell death protein 1, also known as PD-1, and/or an antagonist of PD-L1. As used herein, the term "combination" or "combination therapy" corresponds to the administration of two or more distinct compounds (e.g., an EGFR paTCE and a checkpoint inhibitor) as part of a treatment regimen. The two or more compounds may be administered simultaneously or sequentially. The two or more compounds may be combined into a single composition prior to administration. Each compound in the combination may be separately administered as part of a defined dosing regimen.

PD-1 plays an important role in down-regulating the immune system and promoting self-tolerance by suppressing T cell inflammatory activity. Binding of the PD-1 ligands, PD-L1 and PD-L2 to the PD-1 receptor found in T cells inhibits T-cell proliferation and cytokine production. Upregulation of PD-1 ligands occurs in some tumors and signaling through this pathway can contribute to inhibition of active T-cell immune surveillance of tumors. Anti-PD-1 antibodies bind to the PD-1 receptor and block its interaction with PD-L1 and PD-L3, releasing PD-1 pathway-mediated inhibition of the immune response, including the anti-tumor immune response.

Those of skill in the art are aware of various anti-PD-1 antibodies that may be used. In some embodiments, an exemplary anti-PD-1 antibody used in combination with the compounds of the present invention is Pembrolizumab (Keytruda®). In some embodiments, the anti-PD-1 antibody used in combination with the compound described above is Nivolumab (Opdivo®). In some embodiments, the anti-PD-1 antibody used in combination with the compound described above is Pidilizumab (Medivation).

Additional PD-1 antibodies known to those of skill in the art, include AGEN-2034 (Agenus), AMP-224 (Medimmunc), BCD-100 (Biocad), BGBA-317 (Beigene), BI-754091 (Bochringer Ingelheim), CBT-501 (Genor Biopharma), CC-90006 (Celgene), cemiplimab (Regeneron Pharmaceuticals), durvalumab+MEDI-0680 (Medimmune), GLS-010 (Harbin Gloria Pharmaceuticals), IBI-308 (Eli Lilly), JNJ-3283 (Johnson & Johnson), JS-001 (Shanghai Junshi Bioscience Co.), MEDI-0680 (Medimmune), MGA-012 (MacroGenics), MGD-013 (Marcogenics), pazopanib hydrochloride+pembrolizumab (Novartis), PDR-001 (Novartis), PF-06801591 (Pfizer), SHR-1210 (Jiangsu Hengrui Medicine Co.), TSR-042 (Tesaro Inc.), LZM-009 (Livzon Pharmaceutical Group Inc) and ABBV-181 (AbbVie Inc).

In some embodiments for combination therapy of the present disclosure, the anti-PD-1 antibody is pembrolizumab (Keytruda®).

In some embodiments, the compositions of the present invention are combined with an anti-PD-L1 antibody. Exemplary such anti-PD-L1 antibodies used in the combinations of the present invention may be selected from the group consisting of Durvalumab (MedImmune LLC), Atezolizumab (Hoffmann-La Roche Ltd, Chugai Pharmaceutical Co Ltd), Avelumab (Merck KGaA), CX-072 (CytomX Therapeutics Inc), BMS-936559 (ViiV Healthcare Ltd), SHR-1316 (Jiangsu Hengrui Medicine Co Ltd), M-7824 (Merck KGaA), LY-3300054 (Eli Lilly and Co), FAZ-053 (Novartis AG), KN-035 (AlphaMab Co Ltd), CA-170 (Curis Inc), CK-301 (TG Therapeutics Inc), CS-1001 (CStone Pharmaceuticals Co Ltd), HLX-10 (Shanghai Henlius Biotech Co Ltd), MCLA-145 (Merus NV), MSB-2311 (MabSpace Biosciences (Suzhou) Co Ltd) and MEDI-4736 (Medimmune).

Other immunotherapies and checkpoint inhibitor-based therapies that may be useful in combination with the compositions of the present disclosure include CTLA4, TIGIT, OX40, and TIM3-based therapies.

In some embodiments, the disclosure provides a method of treating cancer in a subject in need thereof, the method comprising administering to the subject an amount of the paTCE described herein to the subject, and a checkpoint inhibitor to the subject, wherein the cancer comprises a solid tumor, and treating the cancer comprises reducing the volume of the solid tumor.

Exemplary Embodiments

Disclosed herein further provides below non-limiting exemplary embodiments:

1. A chimeric polypeptide comprising a bispecific antibody domain,
   wherein the bispecific antibody domain comprises a first antigen binding domain that specifically binds epidermal growth factor receptor (EGFR) and a second antigen binding domain that binds to cluster of differentiation 3 T cell receptor (CD3),
   wherein the first antigen binding domain comprises:
   a VH domain comprising
      a CDR1 amino acid sequence of GGSVSSGDYYWT (SEQ ID NO: 562), a CDR2 amino acid sequence of HIYYSGNTNYNPSLKS (SEQ ID NO: 563), and a CDR3 amino acid sequence of DRVTGAFDI (SEQ ID NO: 564); and
      at least one of: a proline (P) residue at position 40 in FR2, a valine (V) residue at position in position 67 in FR3, a valine (V) residue at position 71 in FR3, an asparagine (N) residue at position 76 in FR3, a valine (V) residue at position 89 in FR3, an alanine (A) residue at position 93 in FR3, and/or a leucine (L) residue at position 108 in FR4, wherein the FR numbering is according to Kabat; and
   a VL domain comprising
      a CDR1 amino acid sequence of QASQDISNYLN (SEQ ID NO: 565), a CDR2 amino acid sequence of DASNLET (SEQ ID NO: 566), a CDR3 amino acid sequence of QHFDHLPLA (SEQ ID NO: 567); and
   wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or EGFR, and wherein the protease-cleavable release segment is cleavable by at least one protease that is present in a tumor.

2. The chimeric polypeptide of embodiment 1, wherein the VH domain comprises an asparagine (N) residue at position 76 in FR3.

3. The chimeric polypeptide of embodiment 1 or 2, wherein the VH domain comprises alanine (A) residue at position 93 in FR3.

4. The chimeric polypeptide of any one of embodiment 1-3, wherein the VH domain comprises a valine (V) residue at position in position 67 in FR3, a valine (V) residue at position 71 in FR3, an asparagine (N) residue at position 76 in FR3, a valine (V) residue at position 89 in FR3, and an alanine (A) residue at position 93 in FR3.

5. The chimeric polypeptide of any one of embodiments 1-4, wherein the VH domain comprises a proline (P) residue at position 40 in FR2, a valine (V) residue at position in position 67 in FR3, a valine (V) residue at position 71 in FR3, an asparagine (N) residue at position 76 in FR3, a valine (V) residue at position 89 in FR3, an alanine (A) residue at position 93 in FR3, and a leucine (L) residue at position 108 in FR4.

6. The chimeric polypeptide of any one of embodiment 1-5, wherein the VL domain comprises at least one of: a tyrosine (Y) residue at position 87 in FR3 and/or a glutamine (Q) residue at position 100 in FR4, wherein the FR numbering is according to Kabat.

7. The chimeric polypeptide of embodiment 6, wherein the VL domain comprises a tyrosine (Y) residue at position 87 in FR3 and a glutamine (Q) residue at position 100 in FR4.

8. The chimeric polypeptide of any one of embodiments 1-7, wherein:
   the VH domain comprises an amino acid sequence of QVQLQX$_1$X$_2$GX$_3$GLX$_4$KPSETLSLTCXsVX$_6$GGSV SSGDYYWTWIRQPPGKGLEWIGHIYYSGNTN YNPSLKSRVTISVDTSKNQFSLKLSSVTAAD-TAVYYCARDRVTGAFDIWGQGTLVTVSS,
   wherein X$_1$ corresponds to E or Q; X$_2$ corresponds to S or W; X$_3$ corresponds to P or A; X$_4$ corresponds to V or L; X$_5$ corresponds to T or A; and X$_6$ corresponds to S or Y (SEQ ID NO: 576); and the VL domain comprises an amino acid sequence of X$_1$IX$_2$X$_3$TQSPX$_4$XLSX$_6$SX-GX$_8$RX$_n$TX$_{10}$X$_1$CQASQDISNYLNWYQQKPGX$_{12}$ APX$_{13}$LLIYDASNLET GX$_{14}$PX$_{15}$RFSGSGSGTDFTX$_{16}$TISX$_{17}$LX$_{18}$PEDX$_{19}$ AX$_{20}$YYCQHFDHLPLAFGQGTKVEIK, wherein X$_1$corresponds to D or E; X$_2$ corresponds to Q or V; X$_3$ corresponds to M or L; X$_4$ corresponds to S, G, or A; X$_5$ corresponds to S or T; X$_6$ corresponds to L or A; X$_7$ corresponds to P or V; Xx corresponds to D or E; X$_9$ corresponds to V or A; X$_{10}$ corresponds to I or L; X$_{11}$ corresponds to T or S; X$_{12}$ corresponds to K or Q; X$_{13}$ corresponds to K or R; X$_{14}$ corresponds to V or I; X$_{15}$ corresponds to S, D, or A; X$_{16}$ corresponds to F or L; X$_{17}$ corresponds to S or R; X$_{18}$ corresponds to Q or E; X$_{19}$ corresponds to I or F; and X$_{20}$ corresponds to T or V (SEQ ID NO: 577).

9. A chimeric polypeptide comprising a bispecific antibody domain,
   wherein the bispecific antibody domain comprises a first antigen binding domain that specifically binds to epidermal growth factor receptor (EGFR) and a second antigen binding domain that binds to cluster of differentiation 3 T cell receptor (CD3),
   wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or EGFR, wherein the protease-cleavable release segment is not capable of being cleaved by legumain in human plasma, or wherein legumain cleaves the protease-cleavable release segment in human plasma at a rate that is less than about 25% of the rate that RSR-2295 (EAGRSANHTPAGLTGP) (SEQ ID NO:7048) is cleaved by legumain.

10. A chimeric polypeptide comprising a bispecific antibody domain, wherein the bispecific antibody domain comprises a first antigen binding domain that specifically binds epidermal growth factor receptor (EGFR) and a second antigen binding domain that binds to cluster of differentiation 3 T cell receptor (CD3), wherein the chimeric polypeptide has a melting temperature ($T_m$) of greater than 62° C. and/or a thermostability ratio of greater than 0.5 at 62° C.;

wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or EGFR, and wherein the protease-cleavable release segment is cleavable by at least one protease that is present in a tumor.

11. The chimeric polypeptide of embodiment 10, wherein the Tm is determined by differential scanning fluorimetry (DSF).

12. The chimeric polypeptide of embodiment 10, wherein the thermostability ratio is determined by:

i) incubating an input amount of a chimeric polypeptide at 62° C. for 30 minutes thereby denaturing a fraction of the input amount of chimeric polypeptide;

ii) measuring an amount of monomeric chimeric polypeptide remaining following step i); and iii) dividing the amount of monomeric chimeric polypeptide by the input amount of the chimeric polypeptide to generate the thermostability ratio.

13. The chimeric polypeptide of embodiment 12, wherein amount of monomeric chimeric polypeptide is measured by mass spectrometry.

14. A chimeric polypeptide comprising a bispecific antibody domain, wherein the bispecific antibody domain comprises a first antigen binding domain that specifically binds a cancer cell antigen and a second antigen binding domain that binds to cluster of differentiation 3 T cell receptor (CD3), wherein the second antigen binding domain comprises:

a VH domain comprising a CDR1 amino acid sequence of GFTFSTYAMN (SEQ ID NO: 12), a CDR2 amino acid sequence of RIRTKRNDYATYYADSVKG (SEQ ID NO: 14), and a CDR3 amino acid sequence of HENFGNSYVSWFAH (SEQ ID NO: 10); and a VL domain comprising a CDR1 amino acid sequence of RSSNGAVTSSNYAN (SEQ ID NO: 1), a CDR2 amino acid sequence of GTNKRAP (SEQ ID NO: 4), and a CDR3 amino acid sequence of ALWYPNLWV (SEQ ID NO: 6).

wherein the chimeric polypeptide further comprises a mask polypeptide joined to the bispecific antibody domain via a linker comprising a protease-cleavable release segment positioned between the mask polypeptide and the bispecific antibody domain such that the mask polypeptide is capable of reducing the binding of the bispecific antibody domain to CD3 or the cancer cell antigen, and wherein the protease-cleavable release segment is cleavable by at least one protease that is present in a tumor.

15. The chimeric polypeptide of embodiment 14, wherein the second antigen binding domain comprises:

(i) the VL domain comprising the amino acid sequence of ELVVTQEPSLTVSPGGTVTLTCRSSN-GAVTSSNYANWVQQKPGQAPRGLIGGTN KRAPGTPARFSGSLLEGKAALTLSGVQ-PEDEAVYYCALWYPNLWVFGGGTKLT VL (SEQ ID NO: 127); and (ii) the VH domain comprising the amino acid sequence of

```
                                    (SEQ ID NO: 126)
EVQLVESGGGIVQPGGSLRLSCAASGFTFSTYAMNWVRQAPGKGLEWVGR

IRTKRNDYATYYADSVKGRFTISRDDSKNTLYLQMNSLKTEDTAVYYCVR

HENFGNSYVSWFAHWGQGTLVTVSS.
```

16. The chimeric polypeptide of embodiment 14 or 15, wherein the cancer cell antigen is human alpha 4 integrin, Ang2, B7-H3, B7-H6, CEACAM5, cMET, CTLA4, FOLR1, EpCAM, CCR5, CD19, EGFR, HER2, HER3, HER4, PD-L1, prostate-specific membrane antigen (PSMA), CEA, MUC1 (mucin), MUC-2, MUC3, MUC4, MUCSAC, MUC5B, MUC7, MUC16 BhCG, Lewis-Y, CD20, CD33, CD38, CD30, CD56 (NCAM), CD133, ganglioside GD3; 9—O-Acetyl-GD3, GM2, Globo H, fucosyl GM1, GD2, carbonican-hydrase IX, CD44v6, Sonic Hedgehog (Shh), Wue-1, plasma cell antigen 1, melanoma chondroitin sulfate proteoglycan (MCSP), CCR8, 6-transmembrane epithelial antigen of prostate (STEAP), mesothelin, A33 antigen, prostate stem cell antigen (PSCA), Ly-6, desmoglein 4, fetal acetylcholine receptor (fnAChR), CD25, cancer antigen 19-9 (CA19-9), cancer antigen 125 (CA-125), Müellerian inhibitory substance receptor type II (MISIIR), sialylated Tn antigen (sTN), fibroblast activation antigen (FAP), endosialin (CD248), tumor-associated antigen L6 (TAL6), SAS, CD63, TAG72, Thomsen-Friedenreich antigen (TF-antigen), insulin-like growth factor I receptor (IGF-IR), Cora antigen, CD7, CD22, CD70, CD79a, CD79b, G250, MT-MMPs, F19 antigen, CA19-9, CA-125, alpha-fetoprotein (AFP), VEGFR1, VEGFR2, DLK1, SP17, ROR1, or EphA2.

17. The chimeric polypeptide of embodiment 14 or 15, wherein the cancer cell antigen is EGFR.

18. The chimeric polypeptide of any one of embodiments 1-17, which comprises a structural arrangement from the N-terminal side to the C-terminal side defined as: (first antigen binding domain)-(second antigen binding domain)-(linker)-(mask polypeptide), (second antigen binding domain)-(first antigen binding domain)-(linker)-(mask polypeptide), (mask polypeptide)-(linker)-(first antigen binding domain)-(second antigen binding domain), or (mask polypeptide)-(linker)-(second antigen binding domain)-(first antigen binding domain), wherein each—is a covalent connection or a polypeptide linker.

19. The chimeric polypeptide of any one of embodiments 1-18, wherein the mask polypeptide is an extended length non-natural polypeptide (ELNN).

20. The chimeric polypeptide of any one of embodiments 1-19, wherein the linker further comprises a spacer.

21. The chimeric polypeptide of any one of embodiments 1-20, wherein the protease-cleavable release segment is fused to the bispecific antibody domain via the spacer.

22. The chimeric polypeptide of embodiment 20 or 21, wherein the spacer is characterized in that:
   (i) at least 90% of its amino acids are glycine (G), alanine (A), serine(S), threonine (T), glutamate (E), proline (P), or any combination thereof; and
   (ii) it comprises at least 3 types of amino acids selected from the group consisting of G, A, S, T, E, and P.

23. The chimeric polypeptide of any one of embodiments 20-22, wherein the spacer is from 9 to 14 amino acids in length.

24. The chimeric polypeptide of any one of embodiments 20-23, wherein the spacer comprises at least 4 types of amino acids selected from the group consisting of G, A, S, T, E, and P.

25. The chimeric polypeptide of any one of embodiments 20-24, wherein the amino acids of the spacer consists of A, E, G, S, P, and/or T.

26. The chimeric polypeptide of any one of embodiments 20-25, wherein the spacer is cleavable by a non-mammalian protease.

27. The chimeric polypeptide of embodiment 26, wherein the non-mammalian protease is Glu-C.

28. The chimeric polypeptide of any one of embodiments 18-27, wherein the spacer comprises an amino acid sequence having at least 85%, 90%, 91%, 92%, 93%, 94%, 95%, 96%, 97%, 98%, or 99% identity, or 100% identity, to a sequence listed in Table C.

29. The chimeric polypeptide of any one of embodiments 20-28, wherein the spacer comprises an amino acid sequence that has at least 85%, 90%, 91%, 92%, 93%, 94%, 95%, 96%, 97%, 98%, or 99% identity, or 100% identity, to GTSESATPES (SEQ ID NO:96) or GTAT-PESGPG (SEQ ID NO:97).

30. The chimeric polypeptide of any one of embodiments 1-29, wherein the protease-cleavable release segment comprises an amino acid sequence comprising the sequence: EAGRSAXHTPAGLTGP (SEQ ID NO: 7627), wherein X is any amino acid other than N.

31. The chimeric polypeptide of embodiment 30, wherein X is S.

32. The chimeric polypeptide of any one of embodiments 1-31, comprising a first mask polypeptide joined to the first antigen binding domain via a first linker wherein the first linker comprises a first protease cleavable release segment (RS1) cleavable by at least one protease present in a tumor; and a second mask polypeptide joined to the second antigen binding domain via a second linker wherein the second linker comprises a second protease cleavable release segment (RS2) cleavable by at least one protease present in a tumor.

33. The chimeric polypeptide of embodiment 32, which comprises a structural arrangement from the N-terminal side to the C-terminal side defined as: (Mask1)-(Linker1)-(first antigen binding domain)-(second antigen binding domain)-(Linker2)-(Mask2), (Mask1)-(Linker1)-(second antigen binding domain)-(first antigen binding domain)-(Linker2)-(Mask2), (Mask2)-(Linker2)-(first antigen binding domain)-(second antigen binding domain)-(Linker1)-(Mask1), or (Mask2)-(Linker2)-(second antigen binding domain)-(first antigen binding domain)-(Linker1)-(Mask1), wherein each—is, individually, a covalent bond or a polypeptide linker.

34. The chimeric polypeptide of embodiment 32 or 33, wherein the first mask polypeptide is a first ELNN (ELNN1) and the second mask polypeptide is a second ELNN (ELNN2).

35. The chimeric polypeptide of embodiment 34, which comprises a structural arrangement from the N-terminal side to the C-terminal side defined as: (ELNN1)-(Linker1)-(first antigen binding domain)-(second antigen binding domain)-(Linker2)-(ELNN2), (ELNN1)-(Linker1)-(second antigen binding domain)-(first antigen binding domain)-(Linker2)-(ELNN2), (ELNN2)-(Linker2)-(first antigen binding domain)-(second antigen binding domain)-(Linker1)-(ELNN1), or (ELNN2)-(Linker2)-(second antigen binding domain)-(first antigen binding domain)-(Linker1)-(ELNN1), wherein each—is, individually, a covalent bond or a polypeptide linker.

36. The chimeric polypeptide of any one of embodiments 32-35, wherein Linker1 further comprises a first spacer (Spacer1).

37. The chimeric polypeptide of any one of embodiments 32-36, wherein Linker2 further comprises a second spacer (Spacer2).

38. The chimeric polypeptide of embodiment 36 or 37, wherein RS1 is fused to the bispecific antibody domain via Spacer1 and/or RS2 is fused to the bispecific antibody domain via Spacer2.

39. The chimeric polypeptide of embodiment 38, which comprises a structural arrangement from the N-terminal side to the C-terminal side defined as: (ELNN1)-(RS1)-(Spacer1)-(first antigen binding domain)-(second antigen binding domain)-(Spacer2)-(RS2)-(ELNN2), (ELNN1)-(RS1)-(Spacer1)-(second antigen binding domain)-(first antigen binding domain)-(Spacer2)-(RS2)-(ELNN2), (ELNN2)-(RS2)-(Spacer2)-(first antigen binding domain)-(second antigen binding domain)-(Spacer1)-(RS1)-(ELNN1), or (ELNN2)-(RS2)-(Spacer2)-(second antigen binding domain)-(first antigen binding domain)-(Spacer1)-(RS1)-(ELNN1), wherein each—is a, individually, covalent bond or a polypeptide linker.

40. The chimeric polypeptide of any one of embodiments 36-39 wherein Spacer 1 and/or the Spacer2 is characterized in that:
   (iii) at least 90% of its amino acids are glycine (G), alanine (A), serine(S), threonine (T), glutamate (E), proline (P), or any combination thereof; and
   (iv) it comprises at least 3 types of amino acids selected from the group consisting of G, A, S, T, E, and P.

41. The chimeric polypeptide of any one of embodiments 36-40, wherein Spacer1 and/or the Spacer2 is from 9 to 14 amino acids in length.

42. The chimeric polypeptide of any one of embodiments 36-41, wherein Spacer1 and/or the Spacer2 comprises at least 4 types of amino acids selected from the group consisting of G, A, S, T, E, and P.

43. The chimeric polypeptide of any one of embodiments 36-42, wherein the amino acids of Spacer1 and/or the Spacer2 consists of A, E, G, S, P, and/or T.

44. The chimeric polypeptide of any one of embodiments 36-43, wherein Spacer1 and/or the Spacer2 comprises an amino acid sequence having at least 85%, 90%, 91%, 92%, 93%, 94%, 95%, 96%, 97%, 98%, or 99% identity, or 100% identity, to a sequence listed in Table C.

45. The chimeric polypeptide of any one of embodiments 36-44, wherein Spacer1 and/or the Spacer2 comprises an amino acid sequence that has at least 85%, 90%, 91%, 92%, 93%, 94%, 95%, 96%, 97%, 98%, or 99% identity, or 100% identity, to GTSESATPES (SEQ ID NO:96) or GTATPESGPG (SEQ ID NO: 97).

46. The chimeric polypeptide of any one of embodiments 34-45, wherein the amino acid sequence of the first ELNN is between 250 amino acids and 350 amino acids in length, and wherein the amino acid sequence of the second ELNN is between 500 amino acids and 600 amino acids in length.

47. The chimeric polypeptide of any one of embodiments 34-46, wherein the amino acid sequence of the first ELNN is 294 amino acids in length, and wherein the amino acid sequence of the second ELNN is 582 amino acids in length.

48. The chimeric polypeptide of any one of embodiments 32-47, wherein RS1 and/or RS2 comprises an amino acid sequence comprising the sequence: EAGRSAX-HTPAGLTGP (SEQ ID NO: 7627), wherein X is any amino acid other than N.

49. The chimeric polypeptide of embodiment 48, wherein X is S.

50. A chimeric polypeptide comprising a bispecific antibody domain,
wherein the bispecific antibody domain comprises a first antigen binding domain that has binding specificity to a cancer cell antigen, and a second antigen binding domain that has binding specificity to an effector cell antigen expressed on an effector cell,
wherein the chimeric polypeptide further comprises a first ELNN joined to the first antigen binding domain via a first linker comprising a first protease-cleavable release segment (RS1) positioned between the first ELNN and the first antigen binding domain such that the first ELNN is capable of reducing the binding of the first antigen binding domain to the cancer cell antigen, wherein the RS1 is cleavable by at least one protease that is present in a tumor,
wherein the chimeric polypeptide further comprises a second ELNN joined to the second antigen binding domain via a second linker comprising second protease-cleavable release segment (RS2) positioned between the second ELNN and the second antigen binding domain such that the second ELNN is capable of reducing the binding of the first antigen binding domain to the effector cell antigen, wherein the RS2 is cleavable by at least one protease that is present in a tumor,
wherein the first ELNN has a shorter amino acid sequence than the second ELNN, and
wherein the cancer cell antigen is EGFR.

51. The chimeric polypeptide of embodiment 50, which comprises a structural arrangement from the N-terminal side to the C-terminal side defined as: (ELNN1)-(Linker1)-(first antigen binding domain)-(second antigen binding domain)-(Linker2)-(ELNN2), (ELNN1)-(Linker1)-(second antigen binding domain)-(first antigen binding domain)-(Linker2)-(ELNN2), (ELNN2)-(Linker2)-(first antigen binding domain)-

(second antigen binding domain)-(Linker1)-(ELNN1), or (ELNN2)-(Linker2)-(second antigen binding domain)-(first antigen binding domain)-(Linker1)-(ELNN1), wherein each—is, individually, a covalent bond or a polypeptide linker.

52. The chimeric polypeptide of embodiment 50 or 51, wherein Linker1 further comprises a first spacer (Spacer1).

53. The chimeric polypeptide of any one of embodiments 50-52, wherein Linker2 further comprises a second spacer (Spacer2).

54. The chimeric polypeptide of embodiment 52 or 53, wherein RS1 is fused to the bispecific antibody domain via Spacer1 and/or RS2 is fused to the bispecific antibody domain via Spacer2.

55. The chimeric polypeptide of embodiment 54, which comprises a structural arrangement from the N-terminal side to the C-terminal side defined as: (ELNN1)-(RS1)-(Spacer1)-(first antigen binding domain)-(second antigen binding domain)-(Spacer2)-(RS2)-(ELNN2), (ELNN1)-(RS1)-(Spacer1)-(second antigen binding domain)-(first antigen binding domain)-(Spacer2)-(RS2)-(ELNN2), (ELNN2)-(RS 2)-(Spacer2)-(first antigen binding domain)-(second antigen binding domain)-(Spacer1)-(RS1)-(ELNN1), or (ELNN2)-(RS2)-(Spacer2)-(second antigen binding domain)-(first antigen binding domain)-(Spacer1)-(RS1)-(ELNN1), wherein each—is a, individually, covalent bond or a polypeptide linker.

56. A chimeric polypeptide comprising a bispecific antibody domain, comprising the formulas that comprises from the N-terminal side to the C-terminal side:
Formula 1: (Mask1)-(RS1)-(Spacer1)-(first antigen binding domain)-[antibody domain linker]-(second antigen binding domain);
Formula 2: (first antigen binding domain)-[antibody domain linker]-(second antigen binding domain)-(Spacer2)-(RS2)-(Mask2); or
Formula 3: (Mask1)-(RS1)-(Spacer1)-(first antigen binding domain)-[antibody domain linker]-(second antigen binding domain)-(Spacer2)-(RS2)-(Mask2),
wherein,
the first antigen binding domain has binding specificity to a cancer cell antigen;
the second antigen binding domain has binding specificity to an effector cell antigen expressed on an effector cell;
each—comprises, individually, a covalent connection or a polypeptide linker;
the Mask1 is a polypeptide that is capable of reducing binding of the first antigen binding domain to its target;
the Mask2 is a polypeptide that is capable of reducing binding of the second antigen binding domain to its target;
if the chimeric polypeptide comprises Formula 1 then the Spacer1 consists of A, E, G, S, P, and/or T residues, if the chimeric polypeptide comprises Formula 2 then the Spacer2 consists of A, E, G, S, P, and/or T residues, and if the chimeric polypeptide comprises Formula 3 then the Spacer 1 and/or the Spacer2 consists of A, E, G, S, P, and/or T residues; and
wherein the cancer cell antigen is EGFR.

57. The chimeric polypeptide of any one of embodiments 18-56, wherein each—is, individually, a covalent connection.

58. The chimeric polypeptide of embodiment 57, wherein each—is, individually, a covalent bond.

59. The chimeric polypeptide of embodiment 57, wherein each—is a peptide bond.

60. The chimeric polypeptide of embodiment 57, wherein each—is, individually, a polypeptide linker of no more than 5 amino acids.

61. The chimeric polypeptide of any one of embodiments 1-60, wherein the second antigen binding domain has binding specificity to human CD3 and cynomolgus monkey CD3.

62. The chimeric polypeptide of any one of embodiments 1-61, wherein the second antigen binding domain has binding specificity to human CD3.

63. The chimeric polypeptide of any one of embodiments 50-60, wherein the effector cell antigen is cluster of differentiation 3 T cell receptor (CD3).

64. The chimeric polypeptide of any one of embodiments 61-63, wherein the CD3 is CD3 epsilon, CD3 delta, CD3 gamma, or CD3 zeta.

65. The chimeric polypeptide of embodiment 64, wherein the CD3 is CD3 epsilon.

66. The chimeric polypeptide of any one of embodiments 33-65, wherein the Mask1 is a first ELNN and the Mask2 is a second ELNN.

67. The chimeric polypeptide of any one of embodiments 36-66, wherein the Spacer1 and/or the Spacer2 is characterized in that:
    (i) at least 90% of its amino acids are glycine (G), alanine (A), serine(S), threonine (T), glutamate (E), proline (P), or any combination thereof; and
    (ii) it comprises at least 3 types of amino acids selected from the group consisting of G, A, S, T, E, and P.

68. The chimeric polypeptide of embodiment 67, wherein the Spacer1 and/or the Spacer2 is from 9 to 14 amino acids in length.

69. The chimeric polypeptide of embodiment 67 or 68, wherein the Spacer 1 and/or the Spacer2 comprises at least 4 types of amino acids selected from the group consisting of G, A, S, T, E, and P.

70. The chimeric polypeptide of any one of embodiments 67-69, wherein the amino acids of the Spacer 1 and/or the Spacer2 consists of A, E, G, S, P, and/or T.

71. The chimeric polypeptide of any one of embodiments 67-70, wherein the Spacer 1 and/or the Spacer2 is cleavable by a non-mammalian protease.

72. The chimeric polypeptide of embodiment 71, wherein the non-mammalian protease is Glu-C.

73. The chimeric polypeptide of any one of embodiments 67-71, wherein the Spacer 1 and/or the Spacer 2 comprises an amino acid sequence having at least 85%, 90%, 91%, 92%, 93%, 94%, 95%, 96%, 97%, 98%, or 99% identity, or 100% identity, to a sequence listed in Table C.

74. The chimeric polypeptide of any one of embodiments 67-71, wherein the Spacer1 and/or the Spacer 2 comprises an amino acid sequence that has at least 85%, 90%, 91%, 92%, 93%, 94%, 95%, 96%, 97%, 98%, or 99% identity, or 100% identity, to GTSESATPES (SEQ ID NO:96) or GTAT-PESGPG (SEQ ID NO:97).

75. The chimeric polypeptide of any one of embodiments 67-74, wherein the amino acid sequence of the first ELNN is at least 100 amino acids shorter than the amino acid sequence of the second ELNN.

76. The chimeric polypeptide of embodiment 75, wherein the amino acid sequence of the first ELNN is at least 200 amino acids shorter than the amino acid sequence of the second ELNN.

77. The chimeric polypeptide of embodiment 75 or 76, wherein the amino acid sequence of the first ELNN is at least 250 amino acids shorter than the amino acid sequence of the second ELNN.

78. The chimeric polypeptide of any one of embodiments 75-77, wherein the amino acid sequence of the first ELNN is between 250 amino acids and 350 amino acids in length, and wherein the amino acid sequence of the second ELNN is between 500 amino acids and 600 amino acids in length.

79. The chimeric polypeptide of any one of embodiments 75-78, wherein the amino acid sequence of the first ELNN is 294 amino acids in length, and wherein the amino acid sequence of the second ELNN is 582 amino acids in length 80. The chimeric polypeptide of any one of embodiments 1-79, wherein the first antigen binding domain comprises a first antibody or an antigen-binding fragment thereof, and wherein the second antigen binding domain comprises a second antibody or an antigen-binding fragment thereof.

81. The chimeric polypeptide of any one of embodiments 1-80, wherein the first antigen binding domain is a Fab, an scFv, or an ISVD.

82. The chimeric polypeptide of any one of embodiments 1-81, wherein the second antigen binding domain is a Fab, an scFV, or an ISVD.

83. The chimeric polypeptide of embodiment 81 or 82, wherein the ISVD is a VHH domain.

84. The chimeric polypeptide of any one of embodiments 1-82, wherein the first antigen binding domain is an scFV.

85. The chimeric polypeptide of any one of embodiments 1-82, wherein the second antigen binding domain is an scFV.

86. The chimeric polypeptide of any one of embodiments 1-85, wherein there is an antibody domain linker between the first antigen binding domain and the second antigen binding domain.

87. The chimeric polypeptide of embodiment 86, wherein the antibody domain linker comprises an amino acid sequence having at least 85%, 90%, 91%, 92%, 93%, 94%, 95%, 96%, 97%, 98%, or 99% identity, or 100% identity, to a sequence listed in Table A or B.

88. The chimeric polypeptide of embodiment 86, wherein the antibody domain linker consists of G and S amino residues.

89. The chimeric polypeptide of embodiment 88, wherein the antibody domain linker is 6-12 residues in length.

90. The chimeric polypeptide of embodiment 88 or 89, wherein the antibody domain linker comprises the amino acid sequence GGGGS (SEQ ID NO:87) or GGGGSGGGS (SEQ ID NO:125).

91. The chimeric polypeptide of any one of embodiments 1-90, wherein the first antigen binding domain and/or the second antigen binding domain comprise an scFv comprising a VL domain, a VH domain, and a linker between the VL domain and the VH domain, wherein the linker consists of A, E, G, S, P, and/or T residues.

92. The chimeric polypeptide of embodiment 91, wherein the linker is characterized in that:
    (i) at least 90% of its amino acids are glycine (G), alanine (A), serine(S), threonine (T), glutamate (E), proline (P), or any combination thereof; and
    (ii) it comprises at least 3 types of amino acids selected from the group consisting of G, A, S, T, E, and P.

93. The chimeric polypeptide of embodiment 91 or 92, wherein the linker between the VL domain and the VH domain is from 25 to 35 amino acids in length.

94. The chimeric polypeptide of any one of embodiments 91-93, wherein the linker between the VL domain and the VH domain comprises at least 4 types of amino acids selected from the group consisting of G, A, S, T, E, and P.

95. The chimeric polypeptide of any one of embodiments 91-94, wherein the amino acids of the linker between the VL domain and the VH domain consists of A, E, G, S, P, and/or T.

96. The chimeric polypeptide of any one of embodiments 91-95, wherein the linker between the VL domain and the VH domain is cleavable by a non-mammalian protease.

97. The chimeric polypeptide of embodiment 96, wherein the non-mammalian protease is Glu-C.

98. The chimeric polypeptide of embodiment 91, wherein linker between the VL domain and the VH domain comprises an amino acid sequence that has at least 85%, 90%, 91%, 92%, 93%, 94%, 95%, 96%, 97%, 98%, or 99% identity, or 100% identity, to SESATPESGPGTSPGAT-PESGPGTSESATP (SEQ ID NO: 81).

99. The chimeric polypeptide of any one of embodiments 1-98, wherein the second antigen binding domain comprises the following CDRs:

a VL domain CDR1 with an amino acid sequence that has at least 85%, 90%, 91%, 92%, 93%, 94%, 95%, 96%, 97%, 98%, or 99% identity, or 100% identity, to RSSX$_1$GAVTX$_2$SNYAN (SEQ ID NO:8023), wherein X$_1$ corresponds to T or N, and X$_2$ corresponds to T or S;

a VL domain CDR2 with an amino acid sequence that has at least 85%, 90%, 91%, 92%, 93%, 94%, 95%, 96%, 97%, 98%, or 99% identity, or 100% identity, to GTNKRAP (SEQ ID NO:4);

a VL domain CDR3 with an amino acid sequence that has at least 85%, 90%, 91%, 92%, 93%, 94%, 95%, 96%, 97%, 98%, or 99% identity, or 100% identity, to ALWYX$_4$NLWV (SEQ ID NO:8024), wherein X$_4$ corresponds to S or P;

a VH domain CDR1 with an amino acid sequence that has at least 85%, 90%, 91%, 92%, 93%, 94%, 95%, 96%, 97%, 98%, or 99% identity, or 100% identity, to GFTFX$_8$TYAMN (SEQ ID NO:8025), wherein Xx corresponds to S or N;

a VH domain CDR2 with an amino acid sequence that has at least 85%, 90%, 91%, 92%, 93%, 94%, 95%, 96%, 97%, 98%, or 99% identity, or 100% identity, to RIRX$_{10}$KX$_{11}$NX$_{12}$YATYYADSVKX$_{13}$ (SEQ ID NO:8026), wherein X$_{10}$ corresponds to T or S, X$_{11}$ corresponds to R or Y, X$_{12}$ corresponds to D or N, and X$_{13}$ corresponds to G or D;

a VH domain CDR3 with an amino acid sequence that has at least 85%, 90%, 91%, 92%, 93%, 94%, 95%, 96%, 97%, 98%, or 99% identity, or 100% identity, to HX$_{14}$NFGNSYVSWFAX$_{15}$ (SEQ ID NO:8027), wherein X$_{14}$ corresponds to E or G, and X$_{15}$ corresponds to H or Y.

100. The chimeric polypeptide of any one of embodiments 1-99, wherein the second antigen binding domain comprises:

a VH domain comprising a CDR1 amino acid sequence of GFTFSTYAMN (SEQ ID NO: 12), a CDR2 amino acid sequence of RIRTKRNDYATYYADSVKG (SEQ ID NO: 14), and a CDR3 amino acid sequence of HENFGNSYVSWFAH (SEQ ID NO: 10); and a VL domain comprising a CDR1 amino acid sequence of RSSNGAVTSSNYAN (SEQ ID NO: 1), a CDR2 amino acid sequence of GTNKRAP (SEQ ID NO: 4), and a CDR3 amino acid sequence of ALWYPNLWV (SEQ ID NO: 6).

101. The chimeric polypeptide of any one of embodiments 1-100, wherein the second antigen binding domain comprises:

a VH domain comprising an amino acid sequence of EVQLVESGGGIVQPGGSLRLSCAASGFTF-STYAMNWVRQAPGKGLEWVGRIRTKRN-DYATYYADSVKGRFTISRDDSKNTLYLQMNSLK-TEDTAVYYCVRHENFGNSYVSWFAHWGQGTLV TVSS (SEQ ID NO: 126); and a VL domain comprising an amino acid sequence of

```
                                    (SEQ ID NO: 127)
ELVVTQEPSLTVSPGGTVTLTCRSSNGAVTSSNYANWVQQKPGQAPRGLI

GGTNKRAPGTPARFSGSLLEGKAALTLSGVQPEDEAVYYCALWYPNLWVF

GGGTKLTVL.
```

102. The chimeric polypeptide of any one of embodiments 2-101, wherein the first antigen binding domain comprises the following CDRs:

a VL domain CDR1 with an amino acid sequence that has at least 85%, 90%, 91%, 92%, 93%, 94%, 95%, 96%, 97%, 98%, or 99% identity, or 100% identity, to QASQDISNYLN (SEQ ID NO:565);

a VL domain CDR2 with an amino acid sequence that has at least 85%, 90%, 91%, 92%, 93%, 94%, 95%, 96%, 97%, 98%, or 99% identity, or 100% identity, to DASNLET (SEQ ID NO:566);

a VL domain CDR3 with an amino acid sequence that has at least 85%, 90%, 91%, 92%, 93%, 94%, 95%, 96%, 97%, 98%, or 99% identity, or 100% identity, to QHFDHLPLA (SEQ ID NO:567);

a VH domain CDR1 with an amino acid sequence that has at least 85%, 90%, 91%, 92%, 93%, 94%, 95%, 96%, 97%, 98%, or 99% identity, or 100% identity, to GGSVSSGDYYWT (SEQ ID NO:562);

a VH domain CDR2 with an amino acid sequence that has at least 85%, 90%, 91%, 92%, 93%, 94%, 95%, 96%, 97%, 98%, or 99% identity, or 100% identity, to HIYYSGNTNYNPSLKS (SEQ ID NO:563); and a VH domain CDR3 with an amino acid sequence that has at least 85%, 90%, 91%, 92%, 93%, 94%, 95%, 96%, 97%, 98%, or 99% identity, or 100% identity, to DRVTGAFDI (SEQ ID NO:564).

103. The chimeric polypeptide of embodiment 102, wherein the VH domain comprises at least one of: a proline (P) residue at position 40 in FR2, a valine (V) residue at position in position 67 in FR3, a valine (V) residue at position 71 in FR3, an asparagine (N) residue at position 76 in FR3, a valine (V) residue at position 89 in FR3, an alanine (A) residue at position 93 in FR3, and/or a leucine (L) residue at position 108 in FR4, wherein the FR numbering is according to Kabat.

104. The chimeric polypeptide of embodiment 102 or 103, wherein the VH domain comprises an asparagine (N) residue at position 76 in FR3.

105. The chimeric polypeptide of any one of embodiments 102-104, wherein the VH domain comprises alanine (A) residue at position 93 in FR3.

106. The chimeric polypeptide of any one of embodiments 102-105, wherein the VH domain comprises a valine (V) residue at position in position 67 in FR3, a valine (V) residue at position 71 in FR3, an asparagine (N) residue at position 76 in FR3, a valine (V) residue at position 89 in FR3, and an alanine (A) residue at position 93 in FR3.

$10^{-7}$. The chimeric polypeptide of any one of embodiments 102-106, wherein the VH domain comprises a proline (P) residue at position 40 in FR2, a valine (V) residue at position in position 67 in FR3, a valine (V) residue at position 71 in FR3, an asparagine (N) residue at position 76 in FR3, a valine (V) residue at position 89 in FR3, an alanine (A) residue at position 93 in FR3, and a leucine (L) residue at position 108 in FR4.

108. The chimeric polypeptide of any one of embodiments 102-10$^{-7}$, wherein the VL domain comprises at least one of: a tyrosine (Y) residue at position 87 in FR3 and/or a glutamine (Q) residue at position 100 in FR4, wherein the FR numbering is according to Kabat.

109. The chimeric polypeptide of any one of embodiments 102-108, wherein the VL domain comprises a tyrosine (Y) residue at position 87 in FR3 and a glutamine (Q) residue at position 100 in FR4.

110. The chimeric polypeptide of any one of embodiments 102-109, wherein the first antigen binding domain comprises a VH domain comprising an amino acid sequence of SEQ ID NO: 576 and a VL domain comprising an amino acid sequence of SEQ ID NO: 577.

111. The chimeric polypeptide of any one of embodiments 1-110, wherein the first antigen binding domain comprises:
  i) a VH domain comprising an amino acid sequence of SEQ ID NO: 468 and a VL domain comprising an amino acid sequence of SEQ ID NO: 469;
  ii) a VH domain comprising an amino acid sequence of SEQ ID NO: 466 and a VL domain comprising an amino acid sequence of SEQ ID NO: 467;
  iii) a VH domain comprising an amino acid sequence of SEQ ID NO: 490 and a VL domain comprising an amino acid sequence of SEQ ID NO: 491;
  iv) a VH domain comprising an amino acid sequence of SEQ ID NO: 492 and a VL domain comprising an amino acid sequence of SEQ ID NO: 493;
  v) a VH domain comprising an amino acid sequence of SEQ ID NO: 514 and a VL domain comprising an amino acid sequence of SEQ ID NO: 515;
  vi) a VH domain comprising an amino acid sequence of SEQ ID NO: 516 and a VL domain comprising an amino acid sequence of SEQ ID NO: 517;
  vii) a VH domain comprising an amino acid sequence of SEQ ID NO: 538 and a VL domain comprising an amino acid sequence of SEQ ID NO: 539; or
  viii) a VH domain comprising an amino acid sequence of SEQ ID NO: 540 and a VL domain comprising an amino acid sequence of SEQ ID NO: 541.

112. The chimeric polypeptide of any one of embodiments 1-111, wherein the VL domain is N-terminal to the VH domain.

113. The chimeric polypeptide of any one of embodiments 1-111, wherein the VL domain is C-terminal to the VH domain.

114. The chimeric polypeptide of any one of embodiments 1-113, wherein the second antigen binding domain comprises a scFV comprising an amino acid sequence that has at least 85%, 90%, 91%, 92%, 93%, 94%, 95%, 96%, 97%, 98%, or 99% identity, or 100% identity, to:

```
                                    (SEQ ID NO: 128)
ELVVTQEPSLTVSPGGTVTLTCRSSNGAVTSSNYANWVQQKPGQAPRGLI
```

```
-continued
GGTNKRAPGTPARFSGSLLEGKAALTLSGVQPEDEAVYYCALWYPNLWVF

GGGTKLTVLSESATPESGPGTSPGATPESGPGTSESATPEVQLVESGGGI

VQPGGSLRLSCAASGFTFSTYAMNWVRQAPGKGLEWVGRIRTKRNDYATY

YADSVKGRFTISRDDSKNTLYLQMNSLKTEDTAVYYCVRHENFGNSYVSW

FAHWGQGTLVTVSS.
```

115. The chimeric polypeptide of any one of embodiments 1-114, wherein the first antigen binding domain comprises a scFV comprising an amino acid sequence that has at least 85%, 90%, 91%, 92%, 93%, 94%, 95%, 96%, 97%, 98%, or 99% identity, or 100% identity, to:

```
                                    (SEQ ID NO: 449)
DIQMTQSPSSLSASVGDRVTITCQASQDISNYLNWYQQKPGKAPKLLIYD

ASNLETGVPSRFSGSGSGTDFTFTISSLQPEDIATYYCQHFDHLPLAFGQ

GTKVEIKSESATPESGPGTSPGATPESGPGTSESATPQVQLQESGPGLVK

PSETLSLTCTVSGGSVSSGDYYWTWIRQPPGKGLEWIGHIYYSGNTNYNP

SLKSRVTISVDTSKNQFSLKLSSVTAADTAVYYCARDRVTGAFDIWGQGT

LVTVSS.
```

116. The chimeric polypeptide of any one of embodiments 1-115, wherein the RS comprises a protease cleavage site is cleavable by at least one protease listed in Table 6.

117. The chimeric polypeptide of any one of embodiments 1-115, wherein the RS comprises an amino acid sequence having at least 85%, 90%, 91%, 92%, 93%, 94%, 95%, 96%, 97%, 98%, or 99% identity, or 100% identity, to a sequence listed in Table 7a.

118. The chimeric polypeptide of any one of embodiments 1-115, wherein the RS is cleavable by uPA, ST14, MMP2, MMP7, MMP9, and MMP14.

119. The chimeric polypeptide of any one of embodiments 1-115, wherein the RS is not cleavable by legumain.

120. The chimeric polypeptide of embodiment 119, wherein the RS is not cleavable by legumain in human blood, plasma, or serum.

121. The chimeric polypeptide of embodiment 119 or 120, wherein the RS is not cleavable upon incubation with about 1 nM or less legumain for about 20 hours.

122. The chimeric polypeptide of any one of embodiments 119-121, wherein the RS is not cleavable upon incubation with about 1 nM or less legumain for about 20 hours in human blood, plasma, or serum.

123. The chimeric polypeptide of embodiment 122, wherein legumain cleaves the RS in human plasma at a rate that is less than about 50% of the rate that RSR-2295 (EAGRSANHTPAGLTGP) (SEQ ID NO: 7048) is cleaved by legumain.

124. The chimeric polypeptide of embodiment 122, wherein legumain cleaves the RS in human plasma at a rate that is less than about 25% of the rate that RSR-2295 (EAGRSANHTPAGLTGP) (SEQ ID NO: 7048) is cleaved by legumain.

125. The chimeric polypeptide of embodiment 122, wherein legumain cleaves the RS in human plasma at a rate that is less than about 10% of the rate that RSR-2295 (EAGRSANHTPAGLTGP) (SEQ ID NO: 7048) is cleaved by legumain.

126. The chimeric polypeptide of embodiment 122, wherein legumain cleaves the RS in human plasma at a rate that is less than about 5% of the rate that RSR-2295 (EAGRSANHTPAGLTGP) (SEQ ID NO: 7048) is cleaved by legumain.

127. The chimeric polypeptide of embodiment 122, wherein legumain cleaves the RS in human plasma at a rate that is less than about 2.5% of the rate that RSR-2295 (EAGRSANHTPAGLTGP) (SEQ ID NO: 7048) is cleaved by legumain.

128. The chimeric polypeptide of any one of embodiments 32-115, wherein the RS1 and/or RS2 comprises protease cleavage is cleavable by at least one protease listed in Table 6.

129. The chimeric polypeptide of any one of embodiments 32-115, wherein the RS1 and/or RS2 comprises an amino acid sequence having at least 85%, 90%, 91%, 92%, 93%, 94%, 95%, 96%, 97%, 98%, or 99% identity, or 100% identity, to a sequence listed in Table 7a.

130. The chimeric polypeptide of any one of embodiments 32-115, wherein the RS1 and/or RS2 is cleavable by uPA, ST14, MMP2, MMP7, MMP9, and MMP14.

131. The chimeric polypeptide of any one of embodiments 32-115, wherein the RS1 and/or RS2 is not cleavable by legumain.

132. The chimeric polypeptide of embodiment 131, wherein the RS1 and/or RS2 is not cleavable by legumain in human blood, plasma, or serum.

133. The chimeric polypeptide of embodiment 131 or 132, wherein the RS1 and/or RS2 is not cleavable upon incubation with about 1 nM or less legumain for about 20 hours.

134. The chimeric polypeptide of embodiment 131 or 132, wherein the RS1 and/or RS2 is not cleavable upon incubation with about 1 nM or less legumain for about 20 hours in human blood, plasma, or serum.

135. The chimeric polypeptide of embodiment 134, wherein legumain cleaves the RS1 and/or RS2 in human plasma at a rate that is less than about 50% of the rate that RSR-2295 (EAGRSANHTPAGLTGP) (SEQ ID NO:7048) is cleaved by legumain.

136. The chimeric polypeptide of embodiment 134, wherein legumain cleaves the RS1 and/or RS2 in human plasma at a rate that is less than about 25% of the rate that RSR-2295 (EAGRSANHTPAGLTGP) (SEQ ID NO:7048) is cleaved by legumain.

137. The chimeric polypeptide of embodiment 134, wherein legumain cleaves the RS1 and/or RS2 in human plasma at a rate that is less than about 10% of the rate that RSR-2295 (EAGRSANHTPAGLTGP) (SEQ ID NO:7048) is cleaved by legumain.

138. The chimeric polypeptide of embodiment 134, wherein legumain cleaves the RS1 and/or RS2 in human plasma at a rate that is less than about 5% of the rate that RSR-2295 (EAGRSANHTPAGLTGP) (SEQ ID NO:7048) is cleaved by legumain.

139. The chimeric polypeptide of embodiment 134, wherein legumain cleaves the RS1 and/or RS2 in human plasma at a rate that is less than about 2.5% of the rate that RSR-2295 (EAGRSANHTPAGLTGP) (SEQ ID NO:7048) is cleaved by legumain.

140. The chimeric polypeptide of any one of embodiments 32-139, wherein the RS1 comprises a protease-cleavable amino acid sequence comprising the sequence: EAGRSAXHTPAGLTGP (SEQ ID NO: 7627), wherein X is any amino acid other than N.

141. The chimeric polypeptide of any one of embodiments 32-140, wherein the RS2 comprises a protease-cleavable amino acid sequence comprising the sequence: EAGRSAXHTPAGLTGP (SEQ ID NO: 7627), wherein X is any amino acid other than N.

142. The chimeric polypeptide of any one of embodiments 32-141, wherein RS1 and/or RS2 comprises a protease-cleavable amino acid sequence comprising the sequence: EAGRSASHTPAGLTGP (SEQ ID NO: 7628).

143. The chimeric polypeptide of any one of embodiments 32-142, wherein the RS1 and the RS2 are the same.

144. The chimeric polypeptide of any one of embodiments 32-142, wherein the RS1 and the RS2 are different.

145. The chimeric polypeptide of any one of embodiments 34-144, wherein the first ELNN and the second ELNN are each individually characterized in that:
(i) at least 90% of each of the first ELNN's and the second ELNN's amino acids are glycine (G), alanine (A), serine(S), threonine (T), glutamate (E), proline (P), or any combination thereof; and
(ii) each comprises at least 3 types of amino acids selected from the group consisting of G, A, S, T, E, and P.

146. The chimeric polypeptide of embodiment 145, wherein the first ELNN and the second ELNN are each individually further characterized in that:
(i) each comprises at least 100 amino acid residues;
(ii) each comprises a plurality of non-overlapping sequence motifs that are each from 9 to 14 amino acids in length, wherein the plurality of non-overlapping sequence motifs comprise a set of non-overlapping sequence motives, wherein each non-overlapping sequence motive of the set of non-overlapping sequence motifs is repeated at least two times in the ELNN.

147. The chimeric polypeptide of embodiment 146, wherein the plurality of non-overlapping sequence motifs comprises at least one non-overlapping sequence motif that occurs only once within the ELNN.

148. The chimeric polypeptide of embodiment 146 or 147, wherein the non-overlapping sequence motifs comprise one of or any combination of the sequence motifs listed in Table 1.

149. The chimeric polypeptide of embodiment 146 or 147, wherein the non-overlapping sequence motifs comprise at least 2, 3, or 4 of the sequence motifs listed in Table 1.

150. The chimeric polypeptide of embodiment 146 or 147, wherein the non-overlapping sequence motifs comprise any one of or any combination of GTSTEPSEGSAP (SEQ ID NO:189), GTSESAT-PESGP (SEQ ID NO:188), GSGPGTSESATP (SEQ ID NO:8028), GSEPATSGSETP (SEQ ID NO: 187), GSPAGSPTSTEE (SEQ ID NO:186), and GTSPSAT-PESGP (SEQ ID NO:8029).

151. The chimeric polypeptide of any one of embodiments 145-150, wherein each of the first ELNN and the second ELNN comprises at least 4 types of amino acids selected from the group consisting of G, A, S, T, E, and P.

152. The chimeric polypeptide of any one of embodiments 145-151, wherein the amino acids of each of the first ELNN and the second ELNN consists of A, E, G, S, P, and/or T.

153. The chimeric polypeptide of any one of embodiments 145-152, wherein the amino acid sequence of the first ELNN is at least 100 amino acids shorter than the amino acid sequence of the second ELNN.

154. The chimeric polypeptide of any one of embodiments 145-152, wherein the amino acid sequence of the first ELNN is at least 200 amino acids shorter than the amino acid sequence of the second ELNN.

155. The chimeric polypeptide of any one of embodiments 145-152, wherein the amino acid sequence of the first ELNN is at least 250 amino acids shorter than the amino acid sequence of the second ELNN.

156. The chimeric polypeptide of any one of embodiments 145-152, wherein the amino acid sequence of the first ELNN is between 250 amino acids and 350 amino acids in length, and wherein the amino acid sequence of the second ELNN is between 500 amino acids and 600 amino acids in length.

157. The chimeric polypeptide of any one of embodiments 145-152, wherein the amino acid sequence of the first ELNN is 294 amino acids in length, and wherein the amino acid sequence of the second ELNN is 582 amino acids in length.

158. The chimeric polypeptide of any one of embodiments 145-157, wherein the first ELNN and/or the second ELNN comprises an amino acid sequence that is at least 85% identical to an amino acid sequence listed in Table 3a or 3b.

159. The chimeric polypeptide of any one of embodiments 145-158, wherein the first ELNN comprises an amino acid sequence that has at least 85%, 90%, 91%, 92%, 93%, 94%, 95%, 96%, 97%, 98%, or 99% identity, or 100% identity, to:

```
                               (SEQ ID NO: 8021)
ASSATPESGPGTSTEPSEGSAPGTSESATPESGPGSGPGTSESATPGTSE

SATPESGPGSEPATSGSETPGTSESATPESGPGTSTEPSEGSAPGSPAGS

PTSTEEGTSESATPESGPGSEPATSGSETPGTSESATPESGPGSPAGSPT

STEEGSPAGSPTSTEEGTSTEPSEGSAPGTSESATPESGPGTSESATPES

GPGTSESATPESGPGSEPATSGSETPGSEPATSGSETPGSPAGSPTSTEE

GTSTEPSEGSAPGTSTEPSEGSAPGSEPATSGSETPGTSESATP.
```

160. The chimeric polypeptide of any one of embodiments 145-159, wherein the second ELNN comprises an amino acid sequence that has at least 85%, 90%, 91%, 92%, 93%, 94%, 95%, 96%, 97%, 98%, or 99% identity, or 100% identity, to:

```
                               (SEQ ID NO: 8022)
ATPESGPGTSESATPESGPGSPAGSPTSTEEGTSESATPESGPGSEPATS

GSETPGTSESATPESGPGTSTEPSEGSAPGTSTEPSEGSAPGTSTEPSEG

SAPGTSTEPSEGSAPGTSTEPSEGSAPGTSTEPSEGSAPGSPAGSPTSTE

EGTSTEPSEGSAPGTSESATPESGPGSEPATSGSETPGTSESATPESGPG

SEPATSGSETPGTSESATPESGPGTSTEPSEGSAPGTSESATPESGPGSP

AGSPTSTEEGSPAGSPTSTEEGSPAGSPTSTEEGTSESATPESGPGTSTE

PSEGSAPGTSESATPESGPGSEPATSGSETPGTSESATPESGPGSEPATS

GSETPGTSESATPESGPGTSTEPSEGSAPGSPAGSPTSTEEGTSESATPE
```

```
-continued
SGPGSEPATSGSETPGTSESATPESGPGSPAGSPTSTEEGSPAGSPTSTE

EGTSTEPSEGSAPGTSESATPESGPGTSESATPESGPGTSPSATPESGPG

SEPATSGSETPGSEPATSGSETPGSPAGSPTSTEEGTSTEPSEGSAPGTS

TEPSEGSAPGSEPATSGSETPGTSESAGEPEA.
```

161. The chimeric polypeptide of any one of embodiments 1-160, comprising one or more barcode fragments.

162. The chimeric polypeptide of any one of embodiments 1-161, comprising two or more barcode fragments.

163. The chimeric polypeptide of embodiment 161 or 162, wherein each barcode fragment is different from every other barcode fragment.

164. The chimeric polypeptide of any one of embodiments 161-163, wherein each barcode fragment differs in both sequence and molecular weight from all other peptide fragments that are releasable from the chimeric polypeptide upon complete digestion the chimeric polypeptide by a non-mammalian protease.

165. The chimeric polypeptide of embodiment 164, wherein the non-mammalian protease is Glu-C.

166. The chimeric polypeptide of any one of embodiments 1-165, comprising a Glu-C cleavage site comprising one of the following amino acid sequences: ATPESGPG (SEQ ID NO:8030), SGSETPGT (SEQ ID NO:8031), and GTSESATP (SEQ ID NO:8032).

167. The chimeric polypeptide of any one of embodiments 1-165, comprising at least one of the following amino acid sequences: SGPE.SGPGX$_n$SGPE.SGPG (SEQ ID NO:8033),

```
                               (SEQ ID NO: 8034)
          SGPE.SGPGX$_n$ATPE.SGPG, (SEQ ID NO: 8036)
          SGPE.SGPGX$_n$GTSE.SATP, (SEQ ID NO: 8037)
          SGPE.SGPGX$_n$TTPE.SGPG, (SEQ ID NO: 8038)
          SGPE.SGPGX$_n$STPE.SGPG, (SEQ ID NO: 8039)
          SGPE.SGPGX$_n$GTPE.SGPG, (SEQ ID NO: 8040)
          SGPE.SGPGX$_n$GTPE.TPGS, (SEQ ID NO: 8040)
          SGPE.SGPGX$_n$GTPE.TPGS, (SEQ ID NO: 8041)
          SGPE.SGPGX$_n$SGSE.TGTP, (SEQ ID NO: 8042)
          SGPE.SGPGX$_n$GTPE.GSAP, (SEQ ID NO: 8043)
          SGPE.SGPGX$_n$EPSE.SATP, (SEQ ID NO: 8044)
          ATPE.SGPGX$_n$SGPE.SGPG, (SEQ ID NO: 8045)
          ATPE.SGPGX$_n$ATPE.SGPG, (SEQ ID NO: 8047)
          ATPE.SGPGX$_n$GTSE.SATP,
```

-continued (SEQ ID NO: 8049)
ATPE.SGPGX$_n$TTPE.SGPG, (SEQ ID NO: 8051)
ATPE.SGPGX$_n$STPE.SGPG, (SEQ ID NO: 8053)
ATPE.SGPGX$_n$GTPE.SGPG, (SEQ ID NO: 8055)
ATPE.SGPGX$_n$GTPE.TPGS, (SEQ ID NO: 8056)
ATPE.SGPGX$_n$SGSE.TGTP, (SEQ ID NO: 8057)
ATPE.SGPGX$_n$GTPE.GSAP, (SEQ ID NO: 8058)
ATPE.SGPGX$_n$EPSE.SATP, (SEQ ID NO: 8059)
GTSE.SATPX$_n$SGPE.SGPG, (SEQ ID NO: 8060)
GTSE.SATPX$_n$ATPE.SGPG, (SEQ ID NO: 8061)
GTSE.SATPX$_n$GTSE.SATP, (SEQ ID NO: 8062)
GTSE.SATPX$_n$TTPE.SGPG, (SEQ ID NO: 8063)
GTSE.SATPX$_n$STPE.SGPG, (SEQ ID NO: 8064)
GTSE.SATPX$_n$GTPE.SGPG, (SEQ ID NO: 8065)
GTSE.SATPX$_n$GTPE.TPGS, (SEQ ID NO: 8066)
GTSE.SATPX$_n$SGSE.TGTP, (SEQ ID NO: 8067)
GTSE.SATPX$_n$GTPE.GSAP, (SEQ ID NO: 8068)
GTSE.SATPX$_n$EPSE.SATP, (SEQ ID NO: 8069)
TTPE.SGPGX$_n$SGPE.SGPG, (SEQ ID NO: 8070)
TTPE.SGPGX$_n$ATPE.SGPG, (SEQ ID NO: 8071)
TTPE.SGPGX$_n$GTSE.SATP, (SEQ ID NO: 8072)
TTPE.SGPGX$_n$TTPE.SGPG, (SEQ ID NO: 8074)
TTPE.SGPGX$_n$STPE.SGPG, (SEQ ID NO: 8075)
TTPE.SGPGX$_n$GTPE.SGPG, (SEQ ID NO: 8076)
TTPE.SGPGX$_n$GTPE.TPGS, (SEQ ID NO: 8077)
TTPE.SGPGX$_n$SGSE.TGTP, (SEQ ID NO: 8078)
TTPE.SGPGX$_n$GTPE.GSAP, (SEQ ID NO: 8079)
TTPE.SGPGX$_n$EPSE.SATP, -continued (SEQ ID NO: 8080)
STPE.SGPGX$_n$SGPE.SGPG, (SEQ ID NO: 8081)
STPE.SGPGX$_n$ATPE.SGPG, (SEQ ID NO: 8082)
STPE.SGPGX$_n$GTSE.SATP, (SEQ ID NO: 8083)
STPE.SGPGX$_n$TTPE.SGPG, (SEQ ID NO: 8084)
STPE.SGPGX$_n$STPE.SGPG, (SEQ ID NO: 8086)
STPE.SGPGX$_n$GTPE.SGPG, (SEQ ID NO: 8087)
STPE.SGPGX$_n$GTPE.TPGS, (SEQ ID NO: 8088)
STPE.SGPGX$_n$SGSE.TGTP, (SEQ ID NO: 8089)
STPE.SGPGX$_n$GTPE.GSAP, (SEQ ID NO: 8090)
STPE.SGPGX$_n$EPSE.SATP, (SEQ ID NO: 8091)
GTPE.SGPGX$_n$SGPE.SGPG, (SEQ ID NO: 8092)
GTPE.SGPGX$_n$ATPE.SGPG, (SEQ ID NO: 8093)
GTPE.SGPGX$_n$GTSE.SATP, (SEQ ID NO: 8094)
GTPE.SGPGX$_n$TTPE.SGPG, (SEQ ID NO: 8096)
GTPE.SGPGX$_n$STPE.SGPG, (SEQ ID NO: 8098)
GTPE.SGPGX$_n$GTPE.SGPG, (SEQ ID NO: 8100)
GTPE.SGPGX$_n$GTPE.TPGS, (SEQ ID NO: 8101)
GTPE.SGPGX$_n$SGSE.TGTP, (SEQ ID NO: 8102)
GTPE.SGPGX$_n$GTPE.GSAP, (SEQ ID NO: 8103)
GTPE.SGPGX$_n$EPSE.SATP, (SEQ ID NO: 8104)
GTPE.TPGSX$_n$SGPE.SGPG, (SEQ ID NO: 8105)
GTPE.TPGSX$_n$ATPE.SGPG, (SEQ ID NO: 8106)
GTPE.TPGSX$_n$GTSE.SATP, (SEQ ID NO: 8107)
GTPE.TPGSX$_n$TTPE.SGPG, (SEQ ID NO: 8108)
GTPE.TPGSX$_n$STPE.SGPG, (SEQ ID NO: 8109)
GTPE.TPGSX$_n$GTPE.SGPG, (SEQ ID NO: 8110)
GTPE.TPGSX$_n$GTPE.TPGS, -continued

```
                            (SEQ ID NO: 8111)
GTPE.TPGSX_nSGSE.TGTP, (SEQ ID NO: 8113)
GTPE.TPGSX_nGTPE.GSAP, (SEQ ID NO: 8114)
GTPE.TPGSX_nEPSE.SATP, (SEQ ID NO: 8115)
SGSE.TGTPX_nSGPE.SGPG, (SEQ ID NO: 8116)
SGSE.TGTPX_nATPE.SGPG, (SEQ ID NO: 8117)
SGSE.TGTPX_nGTSE.SATP, (SEQ ID NO: 8118)
SGSE.TGTPX_nTTPE.SGPG, (SEQ ID NO: 8119)
SGSE.TGTPX_nSTPE.SGPG, (SEQ ID NO: 8120)
SGSE.TGTPX_nGTPE.SGPG, (SEQ ID NO: 8121)
SGSE.TGTPX_nGTPE.TPGS, (SEQ ID NO: 8122)
SGSE.TGTPX_nSGSE.TGTP, (SEQ ID NO: 8123)
SGSE.TGTPX_nGTPE.GSAP, (SEQ ID NO: 8124)
SGSE.TGTPX_nEPSE.SATP, (SEQ ID NO: 8125)
GTPE.GSAPX_nSGPE.SGPG, (SEQ ID NO: 8126)
GTPE.GSAPX_nATPE.SGPG, (SEQ ID NO: 8127)
GTPE.GSAPX_nGTSE.SATP, (SEQ ID NO: 8128)
GTPE.GSAPX_nTTPE.SGPG, (SEQ ID NO: 8129)
GTPE.GSAPX_nSTPE.SGPG, (SEQ ID NO: 8130)
GTPE.GSAPX_nGTPE.SGPG, (SEQ ID NO: 8131)
GTPE.GSAPX_nGTPE.TPGS, (SEQ ID NO: 8132)
GTPE.GSAPX_nSGSE.TGTP, (SEQ ID NO: 8133)
GTPE.GSAPX_nGTPE.GSAP, (SEQ ID NO: 8134)
GTPE.GSAPX_nEPSE.SATP, (SEQ ID NO: 8136)
EPSE.SATPX_nSGPE.SGPG, (SEQ ID NO: 8137)
EPSE.SATPX_nATPE.SGPG, (SEQ ID NO: 8138)
EPSE.SATPX_nGTSE.SATP, (SEQ ID NO: 8139)
EPSE.SATPX_nTTPE.SGPG,
```

-continued

```
                            (SEQ ID NO: 8140)
EPSE.SATPX_nSTPE.SGPG, (SEQ ID NO: 8141)
EPSE.SATPX_nGTPE.SGPG, (SEQ ID NO: 8142)
EPSE.SATPX_nGTPE.TPGS, (SEQ ID NO: 8143)
EPSE.SATPX_nSGSE.TGTP, (SEQ ID NO: 8144)
EPSE.SATPX_nGTPE.GSAP,
or (SEQ ID NO: 8145)
EPSE.SATPX_nEPSE.SATP,
``` wherein each "." is a Glu-C cleavage site and n is any integer from 0 to 50.

168. The chimeric polypeptide of embodiment 167, comprising at least one of the following amino acid sequences: SGPE.SGPGX_nATPE.SGPG (SEQ ID NO:8035), ATPE.SGPGX_nGTSE.SATP (SEQ ID NO: 8048), ATPE.SGPGX_nTTPE.SGPG (SEQ ID NO:8050), ATPE.SGPGX_nSTPE.SGPG (SEQ ID NO: 8052), ATPE.SGPGX_nATPE.SGPG (SEQ ID NO:8046), ATPE.SGPGX_nGTPE.SGPG (SEQ ID NO: 8054), ATPE.SGPGX_nGTPE.SGPG (SEQ ID NO:8054), ATPE.SGPGX_nATPE.SGPG (SEQ ID NO: 8046), GTPE.SGPGX_nGTPE.SGPG (SEQ ID NO:8099), GTPE.SGPGX_nSTPE.SGPG (SEQ ID NO: 8097), GTPE.SGPGX_nTTPE.SGPG (SEQ ID NO:8095), GTPE.SGPGX_nSTPE.SGPG (SEQ ID NO: 8097), GTPE.TPGSX_nSGSE.TGTP (SEQ ID NO:8112), GTPE.GSAPX_nEPSE.SATP (SEQ ID NO: 8135), ATPE.SGPGX_nGTPE.SGPG (SEQ ID NO:8054), ATPE.SGPGX_nGTPE.SGPG (SEQ ID NO: 8054), ATPE.SGPGX_nATPE.SGPG (SEQ ID NO:8046), ATPE.SGPGX_nGTPE.SGPG (SEQ ID NO: 8054), TTPE.SGPGX_nTTPE.SGPG (SEQ ID NO:8073), or STPE.SGPGX_nSTPE.SGPG (SEQ ID NO: 8085), wherein each "." is a Glu-C cleavage site and n is any integer from 0 to 30.

169. The chimeric polypeptide of embodiments 167 or 168, wherein n is any integer from 1 to 20.

170. The chimeric polypeptide of any one of embodiments 167-169, wherein n is any integer from 5 to 15.

171. The chimeric polypeptide of any one of embodiments 167-169, wherein n is any integer from 3 to 7.

172. The chimeric polypeptide of any one of embodiments 167-169, wherein n is any integer from 5 to 10.

173. The chimeric polypeptide of any one of embodiments 167-169, wherein n is 9.

174. The chimeric polypeptide of any one of embodiments 167-169, wherein n is 4.

175. The chimeric polypeptide of any one of embodiments 167-174, wherein $X_n$ is PGTGTSAT (SEQ ID NO: 8146), PGSGPGT (SEQ ID NO:8147), PGTTPGTT (SEQ ID NO:8148), PGTPPTST (SEQ ID NO: 8149), PGTSPSAT (SEQ ID NO:8150), PGTGSAGT (SEQ ID NO:8151), PGTGGAGT (SEQ ID NO: 8152), PGTSPGAT (SEQ ID NO:8153), PGTSGSGT (SEQ ID NO:8154), PGTSSAST (SEQ ID NO: 8155), PGTGAGTT (SEQ ID NO:8156), PGTGSTST (SEQ ID NO:8157), GSEPATSG (SEQ ID NO: 8158), APGTSTEP (SEQ ID NO:8159), PGTAGSGT (SEQ ID NO:8160), PGTSSGGT (SEQ ID NO: 8161), PGTAGPAT (SEQ ID NO:8162), PGTPGTGT (SEQ ID NO:8163), PGTGGPTT (SEQ ID NO: 8164), or PGTGSGST (SEQ ID NO:8165).

176. The chimeric polypeptide of any one of embodiments 167-174, wherein $X_{11}$ is TGTS (SEQ ID NO: 8166), SGP, TTPG (SEQ ID NO:8167), TPPT (SEQ ID NO:8168), TSPS (SEQ ID NO:8169), TGSA (SEQ ID NO:8170), TGGA (SEQ ID NO:8171), TSPG (SEQ ID NO:8172), TSGS (SEQ ID NO: 8173), TSSA (SEQ ID NO:8174), TGAG (SEQ ID NO:8175), TGST (SEQ ID NO:8176), EPAT (SEQ ID NO:8177), GTST (SEQ ID NO:8178), TAGS (SEQ ID NO:8179), TSSG (SEQ ID NO: 8180), TAGP (SEQ ID NO:8181), TPGT (SEQ ID NO:8182), TGGP (SEQ ID NO:8183), or TGSG (SEQ ID NO:8184).

177. The chimeric polypeptide of any one of embodiments 1-176, wherein neither the N-terminal amino acid nor the C-terminal amino acid of the chimeric polypeptide is included in a barcode fragment.

178. The chimeric polypeptide of any one of embodiments 19-177, comprising an ELNN with a non-overlapping sequence motif that occurs only once within the ELNN, wherein the ELNN further comprises a barcode fragment that includes at least part of the non-overlapping sequence motif that occurs only once within the ELNN.

179. The chimeric polypeptide of any one of embodiments 19-177, comprising a first ELNN with a first barcode fragment and a second ELNN with a second barcode fragment, wherein neither the first barcode fragment nor the second barcode fragment includes a glutamate that is immediately adjacent to another glutamate, if present, in the ELNN that contains the barcode fragment.

180. The chimeric polypeptide of embodiment 179, wherein at least one of the barcode fragments comprises a glutamate at the C-terminus thereof.

181. The chimeric polypeptide of embodiments 178 or 179, wherein at least one of the barcode fragments has an N-terminal amino acid that is immediately preceded by a glutamate in the chimeric polypeptide.

182. The chimeric polypeptide of embodiment 181, wherein the glutamate that precedes the N-terminal amino acid of the barcode fragment is not immediately adjacent to another glutamate.

183. The chimeric polypeptide of any one of embodiments 179-182, wherein at least one of the barcode fragments does not include a second glutamate at a position other than the C-terminus of the barcode fragment unless the second glutamate is immediately followed by a proline.

184. The chimeric polypeptide of any one of embodiments 1-183, comprising a single polypeptide chain, wherein the chimeric polypeptide comprises a barcode fragment that is at a position within the polypeptide chain that is from 10 to 200 amino acids or from 10 to 125 amino acids from the N-terminus or the C-terminus of the chimeric polypeptide.

185. The chimeric polypeptide of any one of embodiments 34-184, wherein the first ELNN is at the N-terminal side of the bispecific antibody domain, and wherein the first barcode fragment is positioned within 200, 150, 100, or 50 amino acids of the N-terminus of the chimeric polypeptide.

186. The chimeric polypeptide of any one of embodiments 34-184, wherein the second ELNN is at the C-terminal side of the bispecific antibody domain, and wherein the second barcode fragment is positioned within 200, 150, 100, or 50 amino acids of the C-terminus of the chimeric polypeptide.

187. The chimeric polypeptide of any one of embodiments 161-186, wherein at least one of the barcode fragments is at least 4 amino acids in length.

188. The chimeric polypeptide of any one of embodiments 161-187, wherein at least one of the barcode fragments is from 4 to 20, from 5 to 15, from 6 to 12, or from 7 to 10 amino acids in length.

189. The chimeric polypeptide of embodiment 188, wherein each mask polypeptide comprises one barcode fragment that is listed in Table 2 or disclosed in Table 3a.

190. The chimeric polypeptide of any one of embodiments 1-189, comprising a barcode fragment comprising an amino acid sequence that has at least 85%, 90%, 91%, 92%, 93%, 94%, 95%, 96%, 97%, 98%, or 99% identity, or 100% identity, to SGPGSGPGTSE (SEQ ID NO:78) or SGPGTSPSATPE (SEQ ID NO:79).

191. The chimeric polypeptide of any one of embodiments 1-189, comprising one barcode fragment comprising an amino acid sequence that is at least 95% identical to SGPGSGPGTSE (SEQ ID NO:78) and one barcode fragment comprising an amino acid sequence that is at least 95% identical to SGPGTSPSATPE (SEQ ID NO:79).

192. The chimeric polypeptide of any one of embodiments 189-191, wherein the barcode fragment consists of A, E, G, S, P, and/or T residues.

193. The chimeric polypeptide of any one of embodiments 189-192 wherein the barcode fragment is part of a mask peptide.

194. The chimeric polypeptide of embodiment 193, wherein the mask peptide is the first ELNN or the second ELNN.

195. A chimeric polypeptide, comprising an amino acid sequence that has at least 85%, 90%, 91%, 92%, 93%, 94%, 95%, 96%, 97%, 98%, or 99% identity, or 100% identity, to:

```
                                     (SEQ ID NO: 1000)
ASSATPESGPGTSTEPSEGSAPGTSESATPESGPGSGPGTSESATPGTSE

SATPESGPGSEPATSGSETPGTSESATPESGPGTSTEPSEGSAPGSPAGS

PTSTEEGTSESATPESGPGSEPATSGSETPGTSESATPESGPGSPAGSPT

STEEGSPAGSPTSTEEGTSTEPSEGSAPGTSESATPESGPGTSESATPES

GPGTSESATPESGPGSEPATSGSETPGSEPATSGSETPGSPAGSPTSTEE

GTSTEPSEGSAPGTSTEPSEGSAPGSEPATSGSETPGTSESATPEAGRSA

SHTPAGLTGPGTSESATPESDIQMTQSPSSLSASVGDRVTITCQASQDIS

NYLNWYQQKPGKAPKLLIYDASNLETGVPSRFSGSGSGTDFTFTISSLQP

EDIATYYCQHFDHLPLAFGQGTKVEIKSESATPESGPGTSPGATPESGPG

TSESATPQVQLQESGPGLVKPSETLSLTCTVSGGSVSSGDYYWTWIRQPP

GKGLEWIGHIYYSGNTNYNPSLKSRVTISVDTSKNQFSLKLSSVTAADTA

VYYCARDRVTGAFDIWGQGTLVTVSSGGGGSELVVTQEPSLTVSPGGTVT

LTCRSSNGAVTSSNYANWVQQKPGQAPRGLIGGTNKRAPGTPARFSGSLL

EGKAALTLSGVQPEDEAVYYCALWYPNLWVFGGGTKLTVLSESATPESGP

GTSPGATPESGPGTSESATPEVQLVESGGGIVQPGGSLRLSCAASGFTFS
```

-continued

```
TYAMNWVRQAPGKGLEWVGRIRTKRNDYATYYADSVKGRFTISRDDSKNT

LYLQMNSLKTEDTAVYYCVRHENFGNSYVSWFAHWGQGTLVTVSSGTATP

ESGPGEAGRSASHTPAGLTGPATPESGPGTSESATPESGPGSPAGSPTST

EEGTSESATPESGPGSEPATSGSETPGTSESATPESGPGTSTEPSEGSAP

GTSTEPSEGSAPGTSTEPSEGSAPGTSTEPSEGSAPGTSTEPSEGSAPGT

STEPSEGSAPGSPAGSPTSTEEGTSTEPSEGSAPGTSESATPESGPGSEP

ATSGSETPGTSESATPESGPGSEPATSGSETPGTSESATPESGPGTSTEP

SEGSAPGTSESATPESGPGSPAGSPTSTEEGSPAGSPTSTEEGSPAGSPT

STEEGTSESATPESGPGTSTEPSEGSAPGTSESATPESGPGSEPATSGSE

TPGTSESATPESGPGSEPATSGSETPGTSESATPESGPGTSTEPSEGSAP

GSPAGSPTSTEEGTSESATPESGPGSEPATSGSETPGTSESATPESGPGS

PAGSPTSTEEGSPAGSPTSTEEGTSTEPSEGSAPGTSESATPESGPGTSE

SATPESGPGTSPSATPESGPGSEPATSGSETPGSEPATSGSETPGSPAGS

PTSTEEGTSTEPSEGSAPGTSTEPSEGSAPGSEPATSGSETPGTSESAGE

PEA.
```

196. The chimeric polypeptide of embodiment 195, comprising the following amino acid sequence:

```
                                   (SEQ ID NO: 1000)
ASSATPESGPGTSTEPSEGSAPGTSESATPESGPGSGPGTSESATPGTSE

SATPESGPGSEPATSGSETPGTSESATPESGPGTSTEPSEGSAPGSPAGS

PTSTEEGTSESATPESGPGSEPATSGSETPGTSESATPESGPGSPAGSPT

STEEGSPAGSPTSTEEGTSTEPSEGSAPGTSESATPESGPGTSESATPES

GPGTSESATPESGPGSEPATSGSETPGSEPATSGSETPGSPAGSPTSTEE

GTSTEPSEGSAPGTSTEPSEGSAPGSEPATSGSETPGTSESATPEAGRSA

SHTPAGLTGPGTSESATPESDIQMTQSPSSLSASVGDRVTITCQASQDIS

NYLNWYQQKPGKAPKLLIYDASNLETGVPSRFSGSGSGTDFTFTISSLQP

EDIATYYCQHFDHLPLAFGQGTKVEIKSESATPESGPGTSPGATPESGPG

TSESATPQVQLQESGPGLVKPSETLSLTCTVSGGSVSSGDYYWTWIRQPP

GKGLEWIGHIYYSGNTNYNPSLKSRVTISVDTSKNQFSLKLSSVTAADTA

VYYCARDRVTGAFDIWGQGTLVTVSSGGGGSELVVTQEPSLTVSPGGTVT

LTCRSSNGAVTSSNYANWVQQKPGQAPRGLIGGTNKRAPGTPARFSGSLL

EGKAALTLSGVQPEDEAVYYCALWYPNLWVFGGGTKLTVLSESATPESGP

GTSPGATPESGPGTSESATPEVQLVESGGGIVQPGGSLRLSCAASGFTFS

TYAMNWVRQAPGKGLEWVGRIRTKRNDYATYYADSVKGRFTISRDDSKNT

LYLQMNSLKTEDTAVYYCVRHENFGNSYVSWFAHWGQGTLVTVSSGTATP

ESGPGEAGRSASHTPAGLTGPATPESGPGTSESATPESGPGSPAGSPTST

EEGTSESATPESGPGSEPATSGSETPGTSESATPESGPGTSTEPSEGSAP

GTSTEPSEGSAPGTSTEPSEGSAPGTSTEPSEGSAPGTSTEPSEGSAPGT

STEPSEGSAPGSPAGSPTSTEEGTSTEPSEGSAPGTSESATPESGPGSEP

ATSGSETPGTSESATPESGPGSEPATSGSETPGTSESATPESGPGTSTEP
```

-continued

```
SEGSAPGTSESATPESGPGSPAGSPTSTEEGSPAGSPTSTEEGSPAGSPT

STEEGTSESATPESGPGTSTEPSEGSAPGTSESATPESGPGSEPATSGSE

TPGTSESATPESGPGSEPATSGSETPGTSESATPESGPGTSTEPSEGSAP

GSPAGSPTSTEEGTSESATPESGPGSEPATSGSETPGTSESATPESGPGS

PAGSPTSTEEGSPAGSPTSTEEGTSTEPSEGSAPGTSESATPESGPGTSE

SATPESGPGTSPSATPESGPGSEPATSGSETPGSEPATSGSETPGSPAGS

PTSTEEGTSTEPSEGSAPGTSTEPSEGSAPGSEPATSGSETPGTSESAGE

PEA.
```

197. A pharmaceutical composition comprising the chimeric polypeptide of any one of embodiments 1-196 and at least one pharmaceutically acceptable excipient.

198. The pharmaceutical composition of embodiment 197, which is in a liquid form or is frozen.

199. The pharmaceutical composition of embodiment 197, which is formulated as a lyophilized powder or cake to be reconstituted prior to administration.

200. An injection device comprising the pharmaceutical composition of embodiment 197.

201. The injection device of embodiment 200, which comprises a syringe.

202. A polynucleotide sequence encoding the chimeric polypeptide of any one of embodiments 1-196.

203. An expression vector comprising the polynucleotide sequence of embodiment 202.

204. A host cell comprising the expression vector of embodiment 203.

205. A method of producing the chimeric polypeptide of any one of embodiments 1-196.

206. The method of embodiment 205, further comprising isolating the chimeric polypeptide from a host cell.

207. A method of treating cancer in a subject in need thereof, the method comprising administering an effective amount of the chimeric polypeptide of any one of embodiments 1-196 to the subject.

208. The method of embodiment 207, wherein the cancer comprises a solid tumor.

209. The method of embodiment 207 or 208, wherein the cancer is a carcinoma, a sarcoma, or a melanoma.

210. The method of any one of embodiments 207-209, wherein the cancer expresses EGFR.

211. The method of any one of embodiments 207-209, wherein the cancer overexpresses EGFR.

212. The method of any one of embodiments 207-209, wherein the cancer comprises cells that express, on average, at least 3,000; 5,000; 10,000; 20,000; 30,000; 40,000; 50,000; 60,000; 70,000; 80,000; 90,000; 100, 000; or 200,000EGFR proteins per cell.

213. The method of any one of embodiments 207-209, wherein the cancer comprises cells having one or more oncogenic mutations in an EGFR gene.

214. The method of any one of embodiments 207-209, wherein the cancer comprises cells having an EGFR gene amplification.

215. The method of embodiment 214, wherein the cells comprise a 2 to 5-fold, 2 to 10-fold, 2 to 15-fold, 2 to 30-fold, 2 to 50-fold, 3 to 5-fold, 3 to 10-fold, 3 to 15-fold, 3 to 30-fold, 3 to 50-fold, 5 to 10-fold, 5 to 15-fold, 5 to 30-fold, or 5 to 50-fold increase in EGFR gene copy number as compared to a non-cancerous cell of the same tissue type.

216. The method of any one of embodiments 207-209, wherein the cancer is lung cancer, colorectal cancer, head and neck cancer, breast cancer, pancreatic cancer, brain cancer, liver cancer, kidney cancer, ovarian cancer, prostate cancer, esophageal cancer, cervical cancer, or bladder cancer.

217. The method of any one of embodiments 207-209, wherein the cancer is lung cancer.

218. The method of embodiment 217, wherein the lung cancer is non-small cell lung cancer.

219. The method of any one embodiments 207-209, wherein the cancer is colorectal cancer.

220. The method of any one of embodiments 207-209, wherein the cancer is head and neck squamous cell carcinoma.

221. The method of any one of embodiments 207-209, wherein the cancer is breast cancer.

222. The method of embodiment 221, wherein the cancer is triple-negative breast cancer.

223. The method of any one of embodiments 207-209, wherein the cancer is brain cancer.

224. The method of embodiment 223, wherein the brain cancer is glioblastoma.

225. The method of any one of embodiments 207-224, further comprising administering a checkpoint inhibitor to the subject.

226. The method of embodiment 225, wherein the checkpoint inhibitor is a PD-1 inhibitor, a PD-L1 inhibitor, or a CTLA-4 inhibitor.

227. The method of embodiment 225, wherein the checkpoint inhibitor is an anti-PD-1 antibody or an anti-PD-L1 antibody.

228. The method of embodiment 225, wherein the checkpoint inhibitor is pembrolizumab or cemiplimab.

229. An antibody or an antigen-binding fragment thereof that specifically binds EGFR, comprising:
a VH domain comprising
  a CDR1 amino acid sequence of GGSVSSGDYYWT (SEQ ID NO: 562), a CDR2 amino acid sequence of HIYYSGNTNYNPSLKS (SEQ ID NO: 563), and a CDR3 amino acid sequence of DRVTGAFDI (SEQ ID NO: 564); and
  at least one of: a proline (P) residue at position 40 in FR2, a valine (V) residue at position in position 67 in FR3, a valine (V) residue at position 71 in FR3, an asparagine (N) residue at position 76 in FR3, a valine residue at position 89 in FR3, an alanine residue at position 93 in FR3, and/or a leucine residue at position 108 in FR4, wherein the FR numbering is according to Kabat; and
a VL domain comprising
  a CDR1 amino acid sequence of QASQDISNYLN (SEQ ID NO: 565), a CDR2 amino acid sequence of DASNLET (SEQ ID NO: 566), a CDR3 amino acid sequence of QHFDHLPLA (SEQ ID NO: 567).

230. The antibody or an antigen-binding fragment thereof of embodiment 229, wherein the VH domain comprises an asparagine (N) residue at position 76 in FR3.

231. The antibody or an antigen-binding fragment thereof of embodiment 229 or 230, wherein the VH domain comprises alanine (A) residue at position 93 in FR3.

232. The antibody or an antigen-binding fragment thereof of any one of embodiments 229-231, wherein the VH domain comprises a valine (V) residue at position in position 67 in FR3, a valine (V) residue at position 71 in FR3, an asparagine (N) residue at position 76 in FR3, a valine (V) residue at position 89 in FR3, and an alanine (A) residue at position 93 in FR3.

233. The antibody or an antigen-binding fragment thereof of any one of embodiments 229-232, wherein the VH domain comprises a proline (P) residue at position 40 in FR2, a valine (V) residue at position in position 67 in FR3, a valine (V) residue at position 71 in FR3, an asparagine (N) residue at position 76 in FR3, a valine (V) residue at position 89 in FR3, an alanine (A) residue at position 93 in FR3, and a leucine (L) residue at position 108 in FR4.

234. The antibody or an antigen-binding fragment thereof of any one of embodiment 229-233, wherein the VL domain comprises at least one of: a tyrosine (Y) residue at position 87 in FR3 and/or a glutamine (Q) residue at position 100 in FR4, wherein the FR numbering is according to Kabat.

235. The antibody or an antigen-binding fragment thereof of any one of embodiments 229-234, wherein the VL domain comprises a tyrosine (Y) residue at position 87 in FR3 and a glutamine (Q) residue at position 100 in FR4.

236. The antibody or an antigen-binding fragment of any one of embodiments 229-235, comprising a VH domain comprising an amino acid sequence that has at least 85%, 90%, 91%, 92%, 93%, 94%, 95%, 96%, 97%, 98%, or 99% identity, or 100% identity, to SEQ ID NO: 576; and a VL domain comprising an amino acid sequence that has at least 85%, 90%, 91%, 92%, 93%, 94%, 95%, 96%, 97%, 98%, or 99% identity, or 100% identity, to SEQ ID NO: 577.

237. The antibody of embodiment 236, comprising:
  i) a VH domain comprising an amino acid sequence of SEQ ID NO: 468 and a VL domain comprising an amino acid sequence of SEQ ID NO: 469;
  ii) a VH domain comprising an amino acid sequence of SEQ ID NO: 466 and a VL domain comprising an amino acid sequence of SEQ ID NO: 467;
  iii) a VH domain comprising an amino acid sequence of SEQ ID NO: 490 and a VL domain comprising an amino acid sequence of SEQ ID NO: 491;
  iv) a VH domain comprising an amino acid sequence of SEQ ID NO: 492 and a VL domain comprising an amino acid sequence of SEQ ID NO: 493;
  v) a VH domain comprising an amino acid sequence of SEQ ID NO: 514 and a VL domain comprising an amino acid sequence of SEQ ID NO: 515;
  vi) a VH domain comprising an amino acid sequence of SEQ ID NO: 516 and a VL domain comprising an amino acid sequence of SEQ ID NO: 517;
  vii) a VH domain comprising an amino acid sequence of SEQ ID NO: 538 and a VL domain comprising an amino acid sequence of SEQ ID NO: 539; or
  viii) a VH domain comprising an amino acid sequence of SEQ ID NO: 540 and a VL domain comprising an amino acid sequence of SEQ ID NO: 541.

238. An anti-CD3 antibody or an antigen-binding fragment thereof, comprising the following CDRs:
a VH domain comprising a CDR1 amino acid sequence of GFTFSTYAMN (SEQ ID NO: 12), a CDR2 amino acid sequence of RIRTKRNDYATYYADSVKG (SEQ ID NO: 14), and a CDR3 amino acid sequence of HENFGNSYVSWFAH (SEQ ID NO: 10); and
a VL domain comprising a CDR1 amino acid sequence of RSSNGAVTSSNYAN (SEQ ID NO:

1), a CDR2 amino acid sequence of GTNKRAP (SEQ ID NO: 4), and a CDR3 amino acid sequence of ALWYPNLWV (SEQ ID NO: 6).

239. The anti-CD3 antibody or an antigen-binding fragment thereof of embodiment 238, wherein:

the VL domain comprises the amino acid sequence of ELVVTQEPSLTVSPGGTVTLTCRSSN-GAVTSSNYANWVQQKPGQAPRGLIGGTN KRAPGTPARFSGSLLEGKAALTLSGVQ-PEDEAVYYCALWYPNLWVFGGGTKLT VL (SEQ ID NO: 127); and the VH domain comprises the amino acid sequence of

```
                                   (SEQ ID NO: 126)
EVQLVESGGGIVQPGGSLRLSCAASGFTFSTYAMNWVRQAPGKGLEWVG

RIRTKRNDYATYYADSVKGRFTISRDDSKNTLYLQMNSLKTEDTAVYYC

VRHENFGNSYVSWFAHWGQGTLVTVSS.
```

The following are examples of compositions and evaluations of compositions of the disclosure. It is understood that various some embodiments may be practiced, given the general description provided above.

INCORPORATION BY REFERENCE

All publications, patents, and patent applications mentioned in this specification are incorporated herein by reference to the same extent as if each individual publication, patent, or patent application was specifically and individually indicated to be incorporated by reference.

EXAMPLES

Example 1. Improved anti-EGFR binding domains

This example demonstrates the engineering, selection, and characterization of anti-EGFR antibody fragments in a paTCE with improved properties, for example, improved thermostability.

A parental anti-EGFR scFv molecule, EGFR.2, is previously described in Internal Patent Publication No. WO/2020/264208. EGFR.2 includes the VH and VL sequences of a human anti-EGFR antibody, panitumumab. The EGFR.2 scFv molecule was determined to have low thermostability, limiting its expression and its developability in a therapeutic context.

In order to identify anti-EGFR antibody fragments with improved properties, the CDRs of panitumumab (Table 8) were grafted in a combinatorial manner into the framework regions from approved monoclonal antibody therapies (VL Table 9 and VH Table 10).

TABLE 8

Panitumumab CDRs

| VL CDR | Sequence | VH CDR | Sequence |
|---|---|---|---|
| CDR-L1 | QASQDISNYLN (SEQ ID NO: 565) | CDR-H1 | GGSVSSGDYYWT (SEQ ID NO: 562) |
| CDR-L2 | DASNLET (SEQ ID NO: 566) | CDR-H2 | HIYYSGNTNYNPSLKS (SEQ ID NO: 563) |
| CDR-L3 | QHFDHLPLA (SEQ ID NO: 567) | CDR-H3 | DRVTGAFDI (SEQ ID NO: 564) |

TABLE 9

VL Framework regions

| VL | VL FR1 | VL FR2 | VL FR3 | VL FR4 |
|---|---|---|---|---|
| Panitumumab | DIQMTQSPS SLSASVGDR VTITC (SEQ ID NO: 8209) | WYQQKPGK APKLLIY (SEQ ID NO: 8210) | GVPSRFSGSG SGTDFTFTIS SLQPEDIATY FC (SEQ ID NO: 8216) | FGGGTK VEIK (SEQ ID NO: 8221) |
| Donor-FW4 mutation | DIQMTQSPS SLSASVGDR VTITC (SEQ ID NO: 8209) | WYQQKPGK APKLLIY (SEQ ID NO: 8210) | GVPSRFSGSG SGTDFTFTIS SLQPEDIATY FC (SEQ ID NO: 8216) | FGGGTK VEIK* (SEQ ID NO: 8212) |
| IGKV1-33 | DIQMTQSPS SLSASVGDR VTITC (SEQ ID NO: 8209) | WYQQKPGK APKLLIY (SEQ ID NO: 8210) | GVPSRFSGSG SGTDFTFTIS SLQPEDIATY YC (SEQ ID NO: 8211) | FGGGTK VEIK* (SEQ ID NO: 8212) |
| IGKV1D-39 | DIQMTQSPS SLSASVGDR VTITC (SEQ ID NO: 8209) | WYQQKPGK APKLLIY (SEQ ID NO: 8210) | GVPSRFSGSG SGTDFTLTIS SLQPEDFATY YC (SEQ ID NO: 8217) | FGGGTK VEIK* (SEQ ID NO: 8212) |
| IGKV3-20 | EIVLTQSPG TLSLSPGER ATLSC (SEQ ID NO: 8213) | WYQQKPGQ APRLLIY (SEQ ID NO: 8215) | GIPDRFSGSG SGTDFTLTIS RLEPEDFAVY YC (SEQ ID NO: 8218) | FGGGTK VEIK* (SEQ ID NO: 8212) |
| IGKV3-11 | EIVLTQSPA TLSLSPGER ATLSC (SEQ ID NO: 8214) | WYQQKPGQ APRLLIY (SEQ ID NO: 8215) | GIPARFSGSG SGTDFTLTIS SLEPEDFAVY YC (SEQ ID NO: 8219) | FGGGTK VEIK* (SEQ ID NO: 8212) |
| IGKV1D-39 (+2) | DIQMTQSPS SLSASVGDR VTITC (SEQ ID NO: 8209) | WYQQKPGK APKLLIY (SEQ ID NO: 8210) | GVPSRFSGSG SGTDFTLTIS SLQPEDFATY FC (SEQ ID NO: 8220) | FGGGTK VEIK* (SEQ ID NO: 8212) |
| IGKV1-33 (+2) | DIQMTQSPS SLSASVGDR VTITC (SEQ ID NO: 8209) | WYQQKPGK APKLLIY (SEQ ID NO: 8210) | GVPSRFSGSG SGTDFTFTIS SLQPEDIATY FC (SEQ ID NO: 8216) | FGGGTK VEIK* (SEQ ID NO: 8212) |

*Sequences from Ling et al. Front. Immunol. Vol. 9 (2018). doi.org/10.3389/fimmu.2018.00469

TABLE 10

| VH Framework regions | | | | |
|---|---|---|---|---|
| VH | VH FR1 | VH FR2 | VH FR3 | VH FR4 |
| Panitu-mumab | QVQLQESGP GLVKPSETL SLTCTVS (SEQ ID NO: 8206) | WIRQSPG KGLEWIG (SEQ ID NO: 8233) | RLTISIDTSK TQFSLKLSSV TAADTAIYYC VR (SEQ ID NO: 8237) | WGQGTM VTVSS (SEQ ID NO: 8290) |
| IGHV1-2 | QVQLVQSGA EVKKPGASV KVSCKAS (SEQ ID NO: 8223) | WVRQAPG QGLEWMG (SEQ ID NO: 8234) | RVTSTRDTSI STAYMELSRL RSDDTVVYYC AR (SEQ ID NO: 8238) | WGQGTL VTVSS* (SEQ ID NO: 67) |
| IGHV1-46 | QVQLVQSGA EVKKPGASV KVSCKAS (SEQ ID NO: 8223) | WVRQAPG QGLEWMG (SEQ ID NO: 8234) | RVTMTRDTST STVYMELSSL RSEDTAVYYC AR (SEQ ID NO: 8239) | WGQGTL VTVSS* (SEQ ID NO: 67) |
| IGHV1-69 | QVQLVQSGA EVKKPGSSV KVSCKAS (SEQ ID NO: 8224) | WVRQAPG QGLEWMG (SEQ ID NO: 8234) | RVTITADEST STAYMELSSL RSEDTAVYYC AR (SEQ ID NO: 8240) | WGQGTL VTVSS* (SEQ ID NO: 67) |
| IGHV3-23 | EVQLLESGG GLVQPGGSL RLSCAAS (SEQ ID NO: 8225) | WVRQAPG KGLEWVS (SEQ ID NO: 8235) | RFTISRDNSK NTLYLQMNSL RAEDTAVYYC AK (SEQ ID NO: 8241) | WGQGTL VTVSS* (SEQ ID NO: 67) |
| IGHV3-30-3 | QVQLVESGG GVVQPGRSL RLSCAAS (SEQ ID NO: 8226) | WVRQAPG KGLEWVA (SEQ ID NO: 64) | RFTISRDNSK NTLYLQMNSL RAEDTAVYYC AR (SEQ ID NO: 8242) | WGQGTL VTVSS* (SEQ ID NO: 67) |
| IGHV3-7 | EVQLVESGG GLVQPGGSL RLSCAAS (SEQ ID NO: 8227) | WVRQAPG KGLEWVA (SEQ ID NO: 64) | RFTISRDNAK NSLYLQMNSL RAEDTAVYYC AR (SEQ ID NO: 8243) | WGQGTL VTVSS* (SEQ ID NO: 67) |
| IGHV3-66 | EVQLVESGG GLVQPGGSL RLSCAAS (SEQ ID NO: 8227) | WVRQAPG KGLEWVS (SEQ ID NO: 8235) | RFTISRDNSK NTLYLQMNSL RAEDTAVYYC AR (SEQ ID NO: 8242) | WGQGTL VTVSS* (SEQ ID NO: 67) |
| IGHV4-34 | QVQLQQWGA GLLKPSETL SLTCAVY (SEQ ID NO: 8228) | WIRQPPG KGLEWIG (SEQ ID NO: 8207) | RVTISVDTSK NQFSLKLSSV TAADTAVYYC AR (SEQ ID NO: 8208) | WGQGTL VTVSS* (SEQ ID NO: 67) |
| IGHV4-59 | QVQLQESGP GLVKPSETL SLTCTVS (SEQ ID NO: 8206) | WIRQPPG KGLEWIG (SEQ ID NO: 8207) | RVTISVDTSK NQFSLKLSSV TAADTAVYYC AR (SEQ ID NO: 8208) | WGQGTL VTVSS* (SEQ ID NO: 67) |
| IGHV5-51 | EVQLVQSGA EVKKPGESL KISCKGS (SEQ ID NO: 8230) | WVRQMPG KGLEWMG (SEQ ID NO: 8236) | QVTISADKSI STAYLQWSSL KASDTAMYYC AR (SEQ ID NO: 8244) | WGQGTL VTVSS* (SEQ ID NO: 67) |

TABLE 10-continued

| VH Framework regions | | | | |
|---|---|---|---|---|
| VH | VH FR1 | VH FR2 | VH FR3 | VH FR4 |
| IGHV7-4-1 | QVQLVQSGS ELKKPGASV KVSCKAS (SEQ ID NO: 8231) | WVRQAPG QGLEWMG (SEQ ID NO: 8234) | RFVFSLDTSV STAYLQICSL KAEDTAVYYC AR (SEQ ID NO: 8245) | WGQGTL VTVSS* (SEQ ID NO: 67) |
| VH1 (Ling) | QVQLVQSGV EVKKPGASV KVSCKAS* (SEQ ID NO: 8232) | WVRQAPG QGLEWMG* (SEQ ID NO: 8234) | RVTLTTDSST TTAYMELKSL QFDDTAVYYC AR (SEQ ID NO: 8246) | WGQGTL VTVSS* (SEQ ID NO: 67) |
| IGHV3-30-3(+2) | QVQLVESGG GVVQPGRSL RLSCAAS (SEQ ID NO: 8226) | WVRQAPG KGLEWVA (SEQ ID NO: 64) | RLTISRDNSK NTLYLQMNSL RAEDTAVYY CVR (SEQ ID NO: 8247) | WGQGTL VTVSS* (SEQ ID NO: 67) |
| IGHV3-7(+2) | EVQLVESGG GLVQPGGSL RLSCAAS (SEQ ID NO: 8227) | WVRQAPG KGLEWVA (SEQ ID NO: 64) | RLTISRDNAK NSLYLQMNSL RAEDTAVYY CVR (SEQ ID NO: 8248) | WGQGTL VTVSS* (SEQ ID NO: 67) |
| IGHV1-69(+2) | QVQLVQSGA EVKKPGSSV KVSCKAS (SEQ ID NO: 8224) | WVRQAPG QGLEWMG (SEQ ID NO: 8234) | RLTITADEST STAYMELSSL RSEDTAVYY CVR (SEQ ID NO: 8249) | WGQGTL VTVSS* (SEQ ID NO: 67) |

*FW sequences from Ling et al. Front. Immunol. Vol. 9 (2018). Doi.org/10.3389/fimmu.2018.00469

Figure 4:
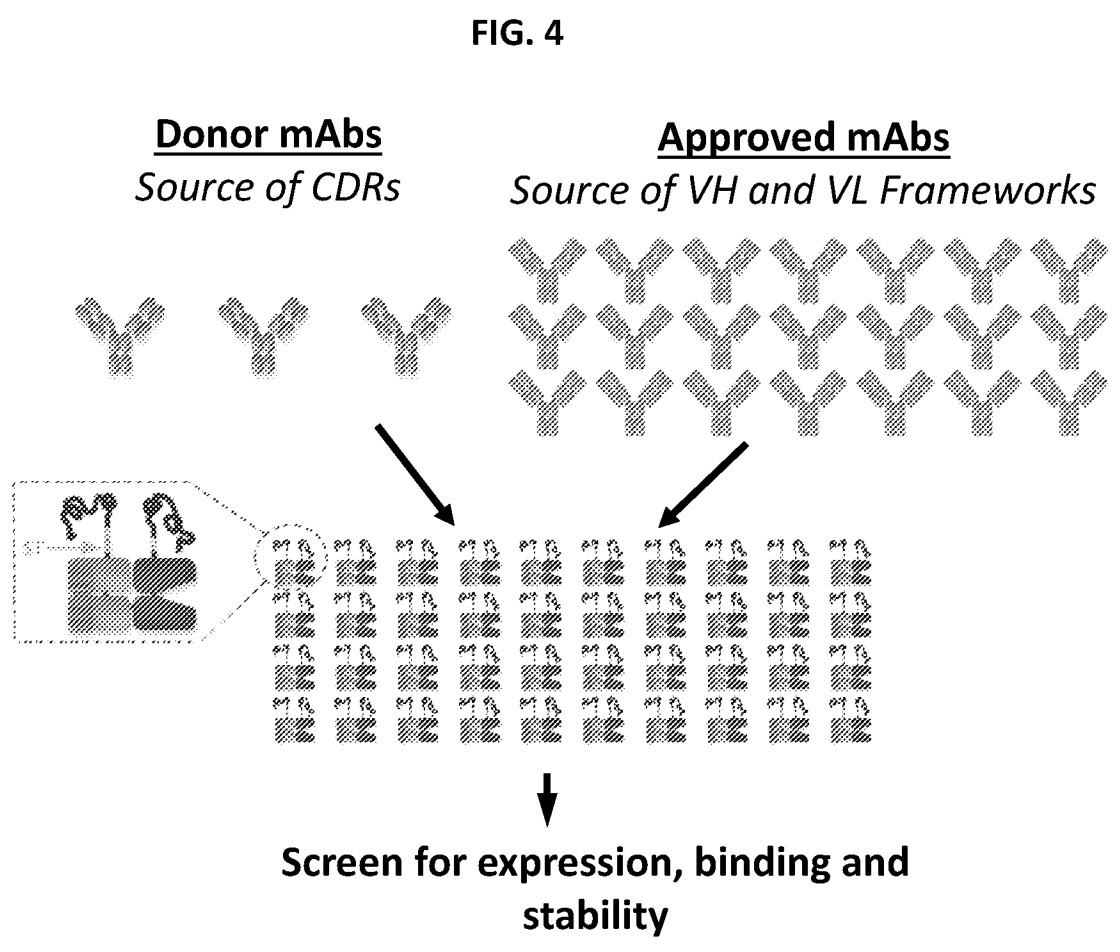
Figures 5A, 5B:
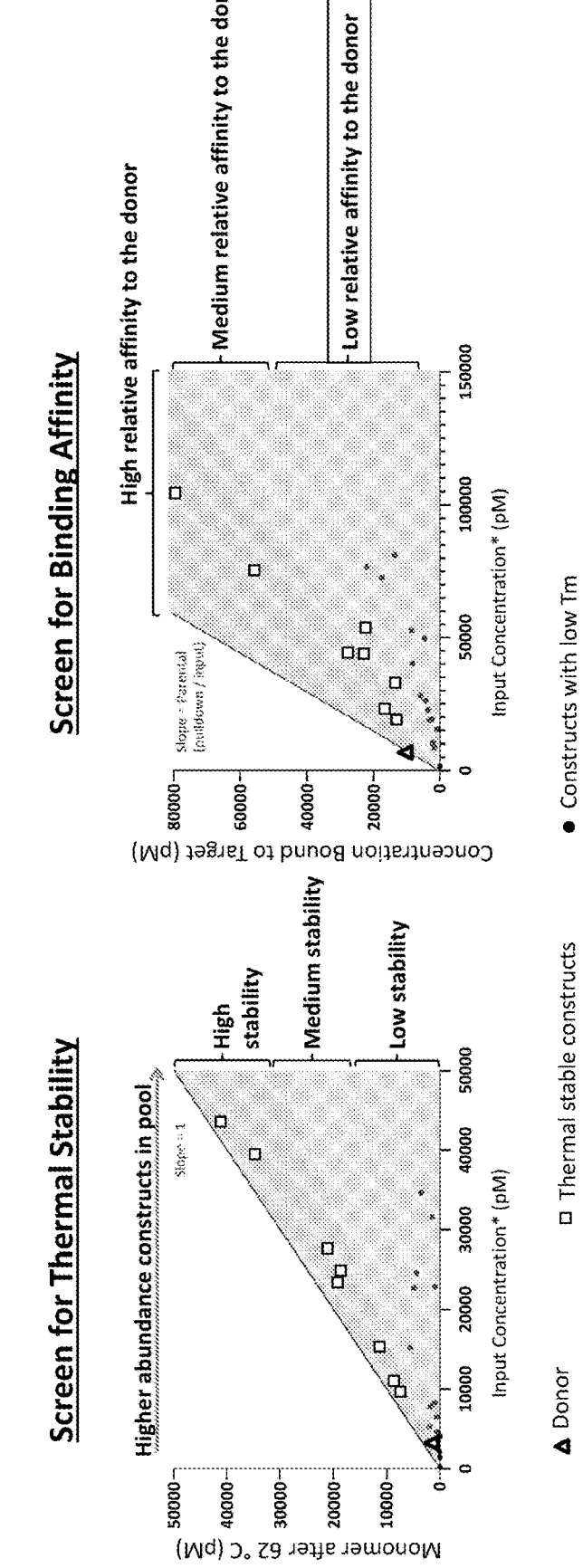
FIG. 5A-FIG. 5D depicts the results from a screen of EGFR-targeted paTCEs for thermal stability (FIG. 5A), binding affinity (FIG. 5B), and a thermostability ratio representing the amount of thermostable monomer remaining at 62° C. as compared to the amount of protein input (FIG. 5C).

The resulting library included approximately 56 anti-EGFR scFvs in paTCE format in combination with anti-CD3 scFv CD3.23. The paTCE library having the anti-EGFR scFvs was screened with the goal of identifying anti-EGFR antibody fragments with improved stability and expression while also exhibiting favorable binding and immunogenicity profiles (FIG. 4). Of the approximately 56 anti-EGFR containing paTCEs screened, 26 were expressed in an amount adequate to further characterize the binding and stability. The 56 constructs were expressed as a pool in a 10 L *E. coli* fermentation run. The protein pool was purified and screened as follows: 1) Magnetic beads coated with human EGFR were incubated with the protein pool at room temperature. The beads were washed, and the bound protein was eluted and analyzed by mass spectrometry for construct identification. 2) The protein pool was heated to 62° C. The heated sample was run through a size exclusion chromatography (SEC) column for separation of monomer from aggregated proteins. The monomer fraction was analyzed by mass spectrometry for construct identification. The screening results are provided in Table 11 and FIG. 5A (screen for thermal stability), FIG. 5B (screen for binding affinity), and FIG. 5C (thermostability ratio).

TABLE 11

| AC# (with CD3.23) | EGFR | CDR Donor | VL FW | VH FW | Expression | Amount Bound | Thermal Stability | Thermo-stability ratio |
|---|---|---|---|---|---|---|---|---|
| | | | | Screening of anti-EGFR scFvs in a paTCE | | | | |
| AC2884 | EGFR.36 | Panitumumab | IGKV1-33 | IGHV4-34 | Low | High | High | 0.76 |
| AC2885 | EGFR.37 | Panitumumab | IGKV1-33 | IGHV4-59 | Med | High | High | 0.78 |
| AC2896 | EGFR.48 | Panitumumab | IGKV1D-39 | IGHV4-34 | Med | Med | High | 0.76 |
| AC2897 | EGFR.49 | Panitumumab | IGKV1D-39 | IGHV4-59 | Med | Med | High | 0.76 |
| AC2908 | EGFR.60 | Panitumumab | IGKV3-20 | IGHV4-34 | High | Med | High | 0.77 |
| AC2909 | EGFR.61 | Panitumumab | IGKV3-20 | IGHV4-59 | High | High | High | 0.94 |
| AC2920 | EGFR.72 | Panitumumab | IGKV3-11 | IGHV4-34 | Med | Med | High | 0.80 |
| AC2921 | EGFR.73 | Panitumumab | IGKV3-11 | IGHV4-59 | High | High | High | 0.86 |
| AC2876 | EGFR.2 (parent) | Panitumumab | Panitumumab | Panitumumab | Low | High | Low | 0.31 |
| AC2879 | EGFR.31 | Panitumumab | IGKV1-33 | IGHV1-69 | Low | Low | Low | 0.13 |
| AC2887 | EGFR.39 | Panitumumab | IGKV1-33 | IGHV7-4-1 | Low | Low | Low | 0.00 |
| AC2888 | EGFR.40 | Panitumumab | IGKV1-33 | VH1 (Ling) | Low | Low | Low | 0.00 |
| AC2890 | EGFR.42 | Panitumumab | IGKV1D-39 | IGHV1-46 | High | Low | Low | 0.10 |
| AC2891 | EGFR.43 | Panitumumab | IGKV1D-39 | IGHV1-69 | Med | Low | Low | 0.24 |
| AC2895 | EGFR.47 | Panitumumab | IGKV1D-39 | IGHV3-66 | Low | Low | Low | 0.16 |
| AC2900 | EGFR.52 | Panitumumab | IGKV1D-39 | VH1 (Ling) | Low | Low | Low | 0.37 |
| AC2903 | EGFR.55 | Panitumumab | IGKV3-20 | IGHV1-69 | High | Low | Low | 0.18 |
| AC2905 | EGFR.57 | Panitumumab | IGKV3-20 | IGHV3-30-3 | Med | Low | Low | 0.14 |
| AC2906 | EGFR.58 | Panitumumab | IGKV3-20 | IGHV3-7 | High | Low | Low | 0.22 |
| AC2907 | EGFR.59 | Panitumumab | IGKV3-20 | IGHV3-66 | Low | Low | Low | 0.11 |
| AC2914 | EGFR.66 | Panitumumab | IGKV3-11 | IGHV1-46 | High | Low | Low | 0.04 |
| AC2915 | EGFR.67 | Panitumumab | IGKV3-11 | IGHV1-69 | High | Low | Low | 0.04 |
| AC2918 | EGFR.70 | Panitumumab | IGKV3-11 | IGHV3-7 | Med | Low | Low | 0.37 |
| AC2919 | EGFR.71 | Panitumumab | IGKV3-11 | IGHV3-66 | Med | Low | Low | 0.12 |
| AC2922 | EGFR.74 | Panitumumab | IGKV3-11 | IGHV5-51 | Med | Low | Low | 0.04 |
| AC2931 | EGFR.87 | Panitumumab | Panitumumab + FRW4mut | Panitumumab + FRW4mut | Low | High | Low | 0.05 |
| AC2877 | EGFR.29 | Panitumumab | IGKV1-33 | IGHV1-2 | Low | n.d. | n.d. | n.d. |
| AC2878 | EGFR.30 | Panitumumab | IGKV1-33 | IGHV1-46 | Low | n.d. | n.d. | n.d. |
| AC2880 | EGFR.32 | Panitumumab | IGKV1-33 | IGHV3-23 | Low | n.d. | n.d. | n.d. |
| AC2881 | EGFR.33 | Panitumumab | IGKV1-33 | IGHV3-30-3 | Low | n.d. | n.d. | n.d. |
| AC2882 | EGFR.34 | Panitumumab | IGKV1-33 | IGHV3-7 | Low | n.d. | n.d. | n.d. |
| AC2883 | EGFR.35 | Panitumumab | IGKV1-33 | IGHV3-66 | Low | n.d. | n.d. | n.d. |
| AC2886 | EGFR.38 | Panitumumab | IGKV1-33 | IGHV5-51 | Low | n.d. | n.d. | n.d. |
| AC2889 | EGFR.41 | Panitumumab | IGKV1D-39 | IGHV1-2 | Low | n.d. | n.d. | n.d. |
| AC2892 | EGFR.44 | Panitumumab | IGKV1D-39 | IGHV3-23 | Low | n.d | n.d. | n.d. |
| AC2893 | EGFR.45 | Panitumumab | IGKV1D-39 | IGHV3-30-3 | Low | n.d. | n.d. | n.d. |
| AC2894 | EGFR.46 | Panitumumab | IGKV1D-39 | IGHV3-7 | Low | n.d. | n.d. | n.d. |
| AC2898 | EGFR.50 | Panitumumab | IGKV1D-39 | IGHV5-51 | Low | n.d. | n.d. | n.d. |
| AC2899 | EGFR.51 | Panitumumab | IGKV1D-39 | IGHV7-4-1 | Low | n.d. | n.d. | n.d. |
| AC2901 | EGFR.53 | Panitumumab | IGKV3-20 | IGHV1-2 | Low | n.d. | n.d. | n.d. |
| AC2902 | EGFR.54 | Panitumumab | IGKV3-20 | IGHV1-46 | Low | n.d. | n.d. | n.d. |
| AC2904 | EGFR.56 | Panitumumab | IGKV3-20 | IGHV3-23 | Low | n.d. | n.d. | n.d. |
| AC2910 | EGFR.62 | Panitumumab | IGKV3-20 | IGHV5-51 | Low | n.d. | n.d. | n.d. |
| AC2911 | EGFR.63 | Panitumumab | IGKV3-20 | IGHV7-4-1 | Low | n.d. | n.d. | n.d. |
| AC2912 | EGFR.64 | Panitumumab | IGKV3-20 | VH1 (Ling) | Low | n.d. | n.d. | n.d. |
| AC2913 | EGFR.65 | Panitumumab | IGKV3-11 | IGHV1-2 | Low | n.d. | n.d. | n.d. |
| AC2916 | EGFR.68 | Panitumumab | IGKV3-11 | IGHV3-23 | Low | n.d. | n.d. | n.d. |
| AC2917 | EGFR.69 | Panitumumab | IGKV3-11 | IGHV3-30-3 | Low | n.d. | n.d. | n.d. |
| AC2923 | EGFR.75 | Panitumumab | IGKV3-11 | IGHV7-4-1 | Low | n.d. | n.d. | n.d. |
| AC2924 | EGFR.76 | Panitumumab | IGKV3-11 | VH1 (Ling) | Low | n.d. | n.d. | n.d. |
| AC2925 | EGFR.81 | Panitumumab | IGKV1D-39(+2) | IGHV3-30-3(+2) | Low | n.d. | n.d. | n.d. |
| AC2926 | EGFR.82 | Panitumumab | IGKV1D-39(+2) | IGHV3-7(+2) | Low | n.d. | n.d. | n.d. |
| AC2927 | EGFR.83 | Panitumumab | IGKV1D-39(+2) | IGHV1-69(+2) | Low | n.d. | n.d. | n.d. |
| AC2928 | EGFR.84 | Panitumumab | IGKV1-33(+2) | IGHV3-30-3(+2) | Low | n.d. | n.d. | n.d. |
| AC2929 | EGFR.85 | Panitumumab | IGKV1-33(+2) | IGHV3-7(+2) | Low | n.d. | n.d. | n.d. |
| AC2930 | EGFR.86 | Panitumumab | IGKV1-33(+2) | IGHV1-69(+2) | Low | n.d. | n.d. | n.d. | n.d. = no data

Anti-EGFR variants in a paTCE format together with CD3.23 were co-expressed and purified as a pool. The pool was subjected to various temperatures for 30 minutes (unheated, heated at 58° C., and heated at 62° C.) to induce denaturation and therefore aggregation. The pool was subsequently placed on ice. The thermostable, monomeric variants which survived the heated conditions were separated from the aggregated variants using anion exchange chromatography. The unheated condition and heated monomeric fractions were run on LCMS to determine individual abundance of each monomeric variant as compared to the input. To analyze the data and select hits: the abundance of each variant in the heated monomeric fraction at 62° C. was divided by its abundance in the unheated, control sample (input).

Figure 5C:
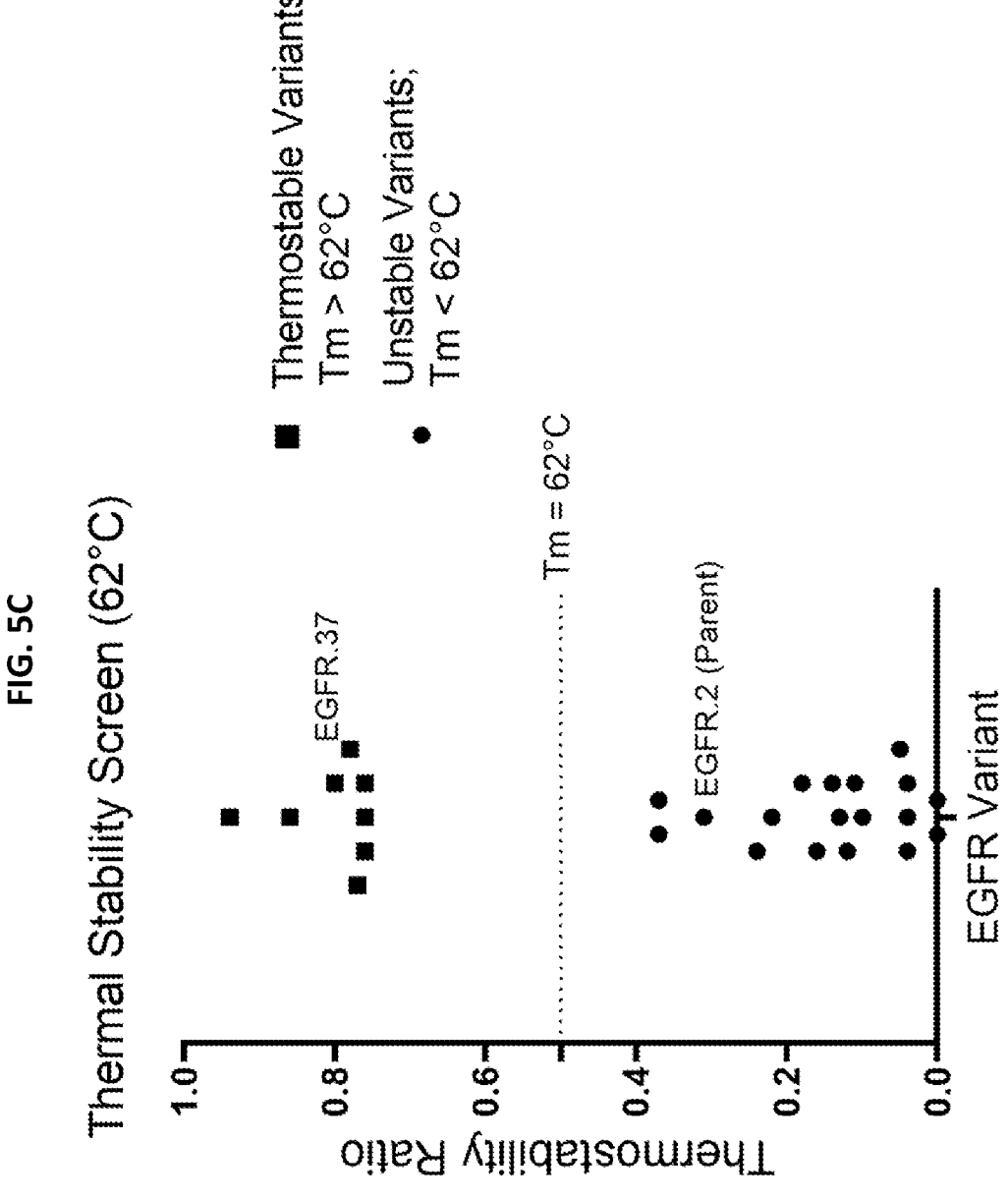

The thermostability ratio above and in FIG. 5C shows the amount of thermostable monomeric protein remaining at 62° C. divided by the input amount. A thermostability ratio value of less than 0.5 suggests that less than 50% protein remains monomeric at 62° C. (e.g., has formed denatured aggregates) and therefore the melting Temperature™ of the protein is less than 62° C. By contrast, a thermostability ratio of more than 0.5 suggests that more than 50% protein remains monomeric at 62° C. and therefore the Tm of the protein in greater than 62° C. FIG. 5C shows the thermostability ratio of the paTCE including EGFR.2/CD3.23 is 0.3 at 62° C., suggesting a Tm of less than 62° C. By contrast, each of the thermostable anti-EGFR variants in combination with CD3.23 has a thermostability ratio of greater than 0.5 at 62° C., suggesting that each of EGFR.36/CD3.23, EGFR.37/CD3.23, EGFR.48/CD3.23, EGFR.49/CD3.23, EGFR.60/CD3.23, EGFR.61/CD3.23, EGFR.72/CD3.23, and EGFR.73/CD3.23 have a Tm of greater than 62° C.

The VH and VL amino acid sequences of the parent anti-EGFR scFv, EGFR.2, and selected thermostable variants are provided in Table 12 (VL), Table 13 (VH). For screening purposes, the anti-EGFR scFv format was VL-linker-VH, with the linker having that amino acid sequence of GATPPETGAETESPGETTGGSAESEPPGEG (SEQ ID NO: 84).

TABLE 12

Sequences of select anti-EGFR scFvs: VL

| anti-EGFR VL | Amino acid sequence |
|---|---|
| EGFR.2 (parent) | DIQMTQSPSSLSASVGDRVTITCQASQDISNYLNWY QQKPGKAPKLLIYDASNLETGVPSRFSGSGSGTDFT FTISSLQPEDIATYFCQHFDHLPLAFGGGTKVEIK (SEQ ID NO: 451) |
| EGFR.36 | DIQMTQSPSSLSASVGDRVTITCQASQDISNYLNWY QQKPGKAPKLLIYDASNLETGVPSRFSGSGSGTDFT FTISSLQPEDIATYYCQHFDHLPLAFGQGTKVEIK (SEQ ID NO: 469) |
| EGFR.37 | DIQMTQSPSSLSASVGDRVTITCQASQDISNYLNWY QQKPGKAPKLLIYDASNLETGVPSRFSGSGSGTDFT FTISSLQPEDIATYYCQHFDHLPLAFGQGTKVEIK (SEQ ID NO: 469) |
| EGFR.48 | DIQMTQSPSSLSASVGDRVTITCQASQDISNYLNWY QQKPGKAPKLLIYDASNLETGVPSRFSGSGSGTDFT LTISSLQPEDFATYYCQHFDHLPLAFGQGTKVEIK (SEQ ID NO: 477) |
| EGFR.49 | DIQMTQSPSSLSASVGDRVTITCQASQDISNYLNWY QQKPGKAPKLLIYDASNLETGVPSRFSGSGSGTDFT LTISSLQPEDFATYYCQHFDHLPLAFGQGTKVEIK (SEQ ID NO: 477) |
| EGFR.60 | EIVLTQSPGTLSLSPGERATLSCQASQDISNYLNWY QQKPGQAPRLLIYDASNLETGIPDRFSGSGSGTDFT LTISRLEPEDFAVYYCQHFDHLPLAFGQGTKVEIK (SEQ ID NO: 501) |
| EGFR.61 | EIVLTQSPGTLSLSPGERATLSCQASQDISNYLNWY QQKPGQAPRLLIYDASNLETGIPDRFSGSGSGTDFT LTISRLEPEDFAVYYCQHFDHLPLAFGQGTKVEIK (SEQ ID NO: 501) |
| EGFR.72 | EIVLTQSPATLSLSPGERATLSCQASQDISNYLNWY QQKPGQAPRLLIYDASNLETGIPARFSGSGSGTDFT LTISSLEPEDFAVYYCQHFDHLPLAFGQGTKVEIK (SEQ ID NO: 525) |

TABLE 12-continued

Sequences of select anti-EGFR scFvs: VL

| anti-EGFR VL | Amino acid sequence |
|---|---|
| EGFR.73 | EIVLTQSPATLSLSPGERATLSCQASQDISNYLNWY QQKPGQAPRLLIYDASNLETGIPARFSGSGSGTDFT LTISSLEPEDFAVYYCQHFDHLPLAFGQGTKVEIK (SEQ ID NO: 525) |

TABLE 13

Sequences of select anti-EGFR scFvs: VH

| anti-EGFR VH | Amino acid sequence |
|---|---|
| EGFR.2 (parent) | QVQLQESGPGLVKPSETLSLTCTVSGGSVSSGDYYW TWIRQSPGKGLEWIGHIYYSGNTNYNPSLKSRLTIS IDTSKTQFSLKLSSVTAADTAIYYCVRDRVTGAFDI WGQGTMVTVSS (SEQ ID NO: 450) |
| EGFR.36 | QVQLQQWGAGLLKPSETLSLTCAVYGGSVSSGDYYW TWIRQPPGKGLEWIGHIYYSGNTNYNPSLKSRVTIS VDTSKNQFSLKLSSVTAADTAVYYCARDRVTGAFDI WGQGTLVTVSS (SEQ ID NO: 466) |
| EGFR.37 | QVQLQESGPGLVKPSETLSLTCTVSGGSVSSGDYYW TWIRQPPGKGLEWIGHIYYSGNTNYNPSLKSRVTIS VDTSKNQFSLKLSSVTAADTAVYYCARDRVTGAFDI WGQGTLVTVSS (SEQ ID NO: 468) |
| EGFR.48 | QVQLQQWGAGLLKPSETLSLTCAVYGGSVSSGDYYW TWIRQPPGKGLEWIGHIYYSGNTNYNPSLKSRVTIS VDTSKNQFSLKLSSVTAADTAVYYCARDRVTGAFDI WGQGTLVTVSS (SEQ ID NO: 466) |
| EGFR.49 | QVQLQESGPGLVKPSETLSLTCTVSGGSVSSGDYYW TWIRQPPGKGLEWIGHIYYSGNTNYNPSLKSRVTIS VDTSKNQFSLKLSSVTAADTAVYYCARDRVTGAFDI WGQGTLVTVSS (SEQ ID NO: 468) |
| EGFR.60 | QVQLQQWGAGLLKPSETLSLTCAVYGGSVSSGDYYW TWIRQPPGKGLEWIGHIYYSGNTNYNPSLKSRVTIS VDTSKNQFSLKLSSVTAADTAVYYCARDRVTGAFDI WGQGTLVTVSS (SEQ ID NO: 466) |
| EGFR.61 | QVQLQESGPGLVKPSETLSLTCTVSGGSVSSGDYYW TWIRQPPGKGLEWIGHIYYSGNTNYNPSLKSRVTIS VDTSKNQFSLKLSSVTAADTAVYYCARDRVTGAFDI WGQGTLVTVSS (SEQ ID NO: 468) |
| EGFR.72 | QVQLQQWGAGLLKPSETLSLTCAVYGGSVSSGDYYW TWIRQPPGKGLEWIGHIYYSGNTNYNPSLKSRVTIS VDTSKNQFSLKLSSVTAADTAVYYCARDRVTGAFDI WGQGTLVTVSS (SEQ ID NO: 466) |
| EGFR.73 | QVQLQESGPGLVKPSETLSLTCTVSGGSVSSGDYYW TWIRQPPGKGLEWIGHIYYSGNTNYNPSLKSRVTIS VDTSKNQFSLKLSSVTAADTAVYYCARDRVTGAFDI WGQGTLVTVSS (SEQ ID NO: 468) |

An alignment of the VH and VL of parental EGFR.2 and selected thermostable variants is provided below (CDRs underlined; differences relative to EGFR.2 highlighted).

VL alignment

```
EGFR.2      DIQMTQSPSSLSASVGDRVTITCQASQDISNYLNWYQQKPGKAPKLLIYDASNLETGVPS    60

EGFR.36     DIQMTQSPSSLSASVGDRVTITCQASQDISNYLNWYQQKPGKAPKLLIYDASNLETGVPS    60

EGFR.37     DIQMTQSPSSLSASVGDRVTITCQASQDISNYLNWYQQKPGKAPKLLIYDASNLETGVPS    60

EGFR.48     DIQMTQSPSSLSASVGDRVTITCQASQDISNYLNWYQQKPGKAPKLLIYDASNLETGVPS    60

EGFR.49     DIQMTQSPSSLSASVGDRVTITCQASQDISNYLNWYQQKPGKAPKLLIYDASNLETGVPS    60

EGFR.60     EIVLTQSPGTLSLSPGERATLSCQASQDISNYLNWYQQKPGQAPRLLIYDASNLETGIPD    60

EGFR.61     EIVLTQSPGTLSLSPGERATLSCQASQDISNYLNWYQQKPGQAPRLLIYDASNLETGIPD    60

EGFR.72     EIVLTQSPATLSLSPGERATLSCQASQDISNYLNWYQQKPGQAPRLLIYDASNLETGIPA    60

EGFR.73     EIVLTQSPATLSLSPGERATLSCQASQDISNYLNWYQQKPGQAPRLLIYDASNLETGIPA    60
            :*  :****.:.** *  *:*.*::******************:**.************:*

EGFR.2      RFSGSGSGTDFTFTISSLQPEDIATYFCQHFDHLPLAFGGGTKVEIK               107
            (SEQ ID NO: 451)

EGFR.36     RFSGSGSGTDFTFTISSLQPEDIATYYCQHFDHLPLAFGQGTKVEIK               107
            (SEQ ID NO: 453)

EGFR.37     RFSGSGSGTDFTFTISSLQPEDIATYYCQHFDHLPLAFGQGTKVEIK               107
            (SEQ ID NO: 453)

EGFR.48     RFSGSGSGTDFTLTISSLQPEDFATYYCQHFDHLPLAFGQGTKVEIK               107
            (SEQ ID NO: 477)

EGFR.49     RFSGSGSGTDFTLTISSLQPEDFATYYCQHFDHLPLAFGQGTKVEIK               107
            (SEQ ID NO: 477)

EGFR.60     RFSGSGSGTDFTLTISRLEPEDFAVYYCQHFDHLPLAFGQGTKVEIK               107
            (SEQ ID NO: 501)

EGFR.61     RFSGSGSGTDFTLTISRLEPEDFAVYYCQHFDHLPLAFGQGTKVEIK               107
            (SEQ ID NO: 501)

EGFR.72     RFSGSGSGTDFTLTISSLEPEDFAVYYCQHFDHLPLAFGQGTKVEIK               107
            (SEQ ID NO: 525)

EGFR.73     RFSGSGSGTDFTLTISSLEPEDFAVYYCQHFDHLPLAFGQGTKVEIK               107
            (SEQ ID NO: 525)
            ************:*** *:***:*.*:************ *******
```

Bold: VL mutations relative to EGFR.2
Bold, double underline. VL mutations conserved in thermostable variants The VL sequences of the thermostable variants included the VL framework regions of IGKV1-33, IGKV1D-39, IGKV3-20, or IGKV3-11 (each with VL FW4 from Ling). Two conserved mutations (F87Y and G100Q, shown in bold in the VL alignment above, numbering according to Kabat) were identified that are present in each of the thermostable variants and which are not present in the donor EGFR.2 VL.

VH alignment

```
EGFR.2      QVQLQESGPGLVKPSETLSLTCTVSGGSVSSGDYYWTWIRQSPGKGLEWIGHIYYSGNTN    60

EGFR.36     QVQLQQWGAGLLKPSETLSLTCAVYGGSVSSGDYYWTWIRQPPGKGLEWIGHIYYSGNTN    60

EGFR.37     QVQLQESGPGLVKPSETLSLTCTVSGGSVSSGDYYWTWIRQPPGKGLEWIGHIYYSGNTN    60

EGFR.48     QVQLQQWGAGLLKPSETLSLTCAVYGGSVSSGDYYWTWIRQPPGKGLEWIGHIYYSGNTN    60

EGFR.49     QVQLQESGPGLVKPSETLSLTCTVSGGSVSSGDYYWTWIRQPPGKGLEWIGHIYYSGNTN    60

EGFR.60     QVQLQQWGAGLLKPSETLSLTCAVYGGSVSSGDYYWTWIRQPPGKGLEWIGHIYYSGNTN    60

EGFR.61     QVQLQESGPGLVKPSETLSLTCTVSGGSVSSGDYYWTWIRQPPGKGLEWIGHIYYSGNTN    60

EGFR.72     QVQLQQWGAGLLKPSETLSLTCAVYGGSVSSGDYYWTWIRQPPGKGLEWIGHIYYSGNTN    60
```

-continued

---

VH alignment

---

```
EGFR.73      QVQLQESGPGLVKPSETLSLTCTVSGGGSVSSGDYYWTWIRQPPGKGLEWIGHIYYSGNTN    60
             *****:  *  **:**********:*  ****************  ******************

EGFR. 2      YNPSLKSRLTISIDTSKTQFSLKLSSVTAADTAIYYCVRDRVTGAFDIWGQGTMVTVSS    119
             (SEQ ID NO: 450)

EGFR.36      YNPSLKSRVTISVDTSKNQFSLKLSSVTAADTAVYYCARDRVTGAFDIWGQGTLVTVSS    119
             (SEQ ID NO: 466)

EGFR.37      YNPSLKSRVTISVDTSKNQFSLKLSSVTAADTAVYYCARDRVTGAFDIWGQGTLVTVSS    119
             (SEQ ID NO: 468)

EGFR.48      YNPSLKSRVTISVDTSKNQFSLKLSSVTAADTAVYYCARDRVTGAFDIWGQGTLVTVSS    119
             (SEQ ID NO: 466)

EGFR.49      YNPSLKSRVTISVDTSKNQFSLKLSSVTAADTAVYYCARDRVTGAFDIWGQGTLVTVSS    119
             (SEQ ID NO: 468)

EGFR.60      YNPSLKSRVTISVDTSKNQFSLKLSSVTAADTAVYYCARDRVTGAFDIWGQGTLVTVSS    119
             (SEQ ID NO: 466)

EGFR.61      YNPSLKSRVTISVDTSKNQFSLKLSSVTAADTAVYYCARDRVTGAFDIWGQGTLVTVSS    119
             (SEQ ID NO: 468)

EGFR.72      YNPSLKSRVTISVDTSKNQFSLKLSSVTAADTAVYYCARDRVTGAFDIWGQGTLVTVSS    119
             (SEQ ID NO: 466)

EGFR.73      YNPSLKSRVTISVDTSKNQFSLKLSSVTAADTAVYYCARDRVTGAFDIWGQGTLVTVSS    119
             (SEQ ID NO: 468)
             ********:***:**** ****************:*** ***************:*****
```

---

Bold: VH mutations relative to EGFR.2
Bold, double underline. VH mutations conserved in thermostable variants Each of the VH sequences of the thermostable variants included the VH FW regions of either IGHV4-34 or IGHV4-59 (each with VH FW4 from Ling). Seven conserved mutations (S40P, L67V, I71V, T76N, I89V, V93A, and M108L; shown in bold in the VH alignment above; numbering according to Kabat) were identified that are present in each of the thermostable variants and which are not present in the donor EGFR.2 VH.

Figure 5D:
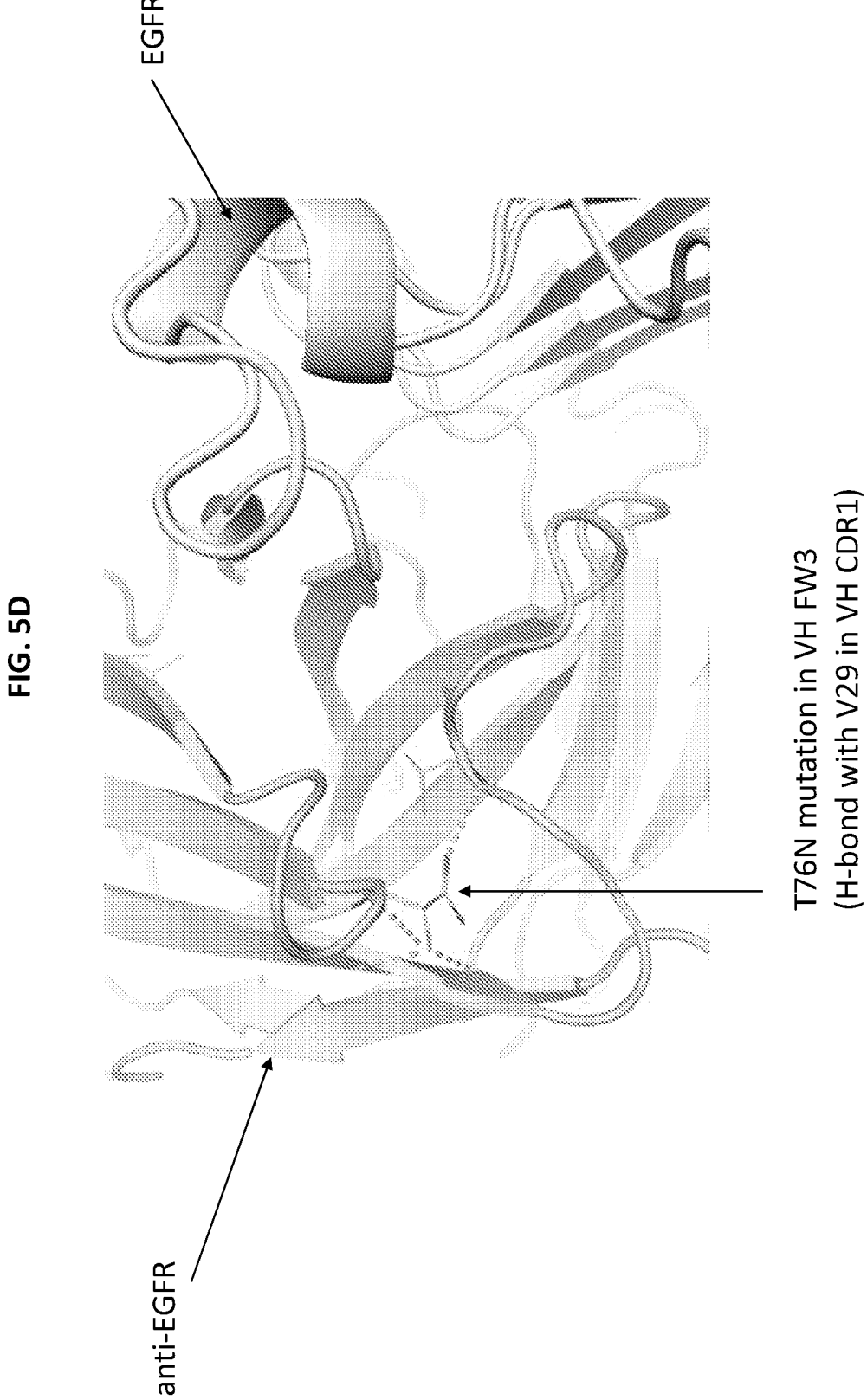

To determine the structural basis for the observed improved thermostability in the anti-EGFR variants, SWISS MODEL was used to simulate the EGFR.2 Fab, using an existing structure of Panitumumab (PDB 5SX$_4$). The same template was used to generate a model of EGFR.2 having a T76N mutation in VH FW3 and thermostable variant EGFR.61 which, like all the other improved thermostable variants, includes the T76N mutation in VH FW3. SWISS MODEL Deep View was used to determine molecular energy using GROMOS. Individual residues and their hydrogen bond partners were analyzed. Residues that resulted in a significant change in energy were analyzed in PyMol. The T76N mutation in the VH FW3 appears to reduce electrostatic clash resulting in a favorable change in free energy. Addition of the T76N mutation resulted in free energy change of −175 (relative to EGFR.2 without the mutation), with a negative change in free energy being predictive of increased stability. As shown in FIG. 5D, the asparagine mutation at position 76 results in a formation of a hydrogen bond with a valine residue at position 29 in the VH CDR1, which may account, at least in part, for the increased stability and decreased binding affinity observed in the thermostable variants.

Based on the screening data, anti-EGFR scFvs were selected for further characterization as individual constructs. Each construct was expressed in small-scale and purified. Thermal stability was determined by Differential Scanning Fluorimetry. Melting temperature (T$_m$) determined by Differential Scanning Fluorimetry experiments described herein were performed either in duplicate or triplicate using GloMelt™ dye and QuantStudio5™. GloMelt™ dye undergoes fluorescence enhancement upon binding to hydrophobic regions of denatured proteins. Therefore, the dye can be used to detect protein unfolding or measure thermal stability. GloMelt™ dye is optimized for detection in the SYBR® Green channel of qPCR instruments. The Differential Scanning Fluorimetry experiments were performed in 96-well plates with 10 μg protein/reaction (equal to 0.5 mg/mL final protein concentration), reaction buffer, and GloMelt™ 10× dye according to manufacturer's instructions. Fluorescence of 96-well plates was read and melt curve plots were generated in the QuantStudio5TM qPCR system. Binding affinity was analyzed with bio-layer interferometry at room temperature with human EGFR as the antigen. The potency of each construct was determined by in vitro cytotoxicity in an HT-29 cell line with an Effector to Target (E: T) ratio of 5 to 1.

The results are provided in Table 14. The loss of potency observed corresponds to the loss in affinity for the anti-EGFR scFvs observed during screening and confirmed here. This result is favorable since decreasing the potency of the paTCE can result in a safer molecule. EGFR.2 was previously shown to cause CRS toxicity, so the lower potency molecules discovered here are desired (see also Example 3).

TABLE 14

| | | | | | | |
|---|---|---|---|---|---|---|
| | | Characterization of anti-EGFR scFvs in a paTCE | | | | |
| AC# | anti-EGFR scFV | Anti-CD3 scFv | Tm (° C.)* | EGFR $K_D$ (nM) | CD3 $K_D$ (nM) | $EC_{50}$HT-29 (pM) |
| AC1955 | EGFR.2 | CD3.9 | n.d. | 0.72 | 99 | 2-4 |
| AC2885 | EGFR.37 | CD3.23 | 66.7 | 2.3 | 203 | 20-29 |
| AC2897 | EGFR.49 | CD3.23 | 66.9 | 7.2 | approx. 203 | n.d. |
| AC2908 | EGFR.60 | CD3.23 | 66.6 | 7.3 | approx. 203 | 94 |
| AC2909 | EGFR.61 | CD3.23 | 67.0 | 2.4 | approx. 203 | 34-40 |
| AC2920 | EGFR.72 | CD3.23 | 67.0 | 4.4 | approx. 203 | 85 |
| AC2921 | EGFR.73 | CD3.23 | 66.9 | 2.45 | approx. 203 | 43-44 |

*Thermostability determined for uTCE; after unmasking by proteolytic cleavage of N- and C-terminal ELNNs EGFR.37 was selected for further characterization. The thermostability of AMX-525 (EGFR.37 in combination with CD3.318) was compared to the thermostability of the parent anti-EGFR paTCE described in Internal Patent Publication No. WO/2020/264208 (EGRF-XPAT gen1; construct ID pJB0169) which includes EGFR.2 in combination with CD3.9. Thermal stability was determined by Differential Scanning Fluorimetry. The results in Table 15 demonstrate that AMX-525 (EGFR.37/CD3.318) is more stable than the EGFR-XPAT gen1 (EGFR.2/CD3.9). Further comparisons of AMX-525 and EGFR-XPAT gen1 are also provided in Example 3.

TABLE 15

| | | | |
|---|---|---|---|
| | Characterization of anti-EGFR scFvs in a paTCE | | |
| AC# | anti-EGFR scFV | Anti-CD3 scFv | Tm (° C.)* |
| AC1955 (EGFR-XPAT gen1) | EGFR.2 | CD3.9 | 59.9 |
| AC4230 (AMX-525) | EGFR.37 | CD3.318 | 68.3 |

*Thermostability determined for masked paTCE

Example 2. Improved Anti-CD3 Binding Domains

CD3 scFv paTCE arm optimization was conducted to reduce molecule immunogenicity and improve stability, while maintaining binding affinity with CD3 close to the affinity observed for the CD3.23 parental molecule. Putative T cell epitope (PTE) scores were calculated based on a proprietary computer prediction program, where a lower PTE score is predictive of decreased immunogenicity.

To achieve this, Pool 1 was created, which included 74 paTCE molecules, each containing an anti-PSMA VHH and one of the 74 CD3.23 mutation variants. The amino acid sequences of each of the 74 CD3.23 mutation variants are provided in Table 18. Single mutations were chosen based on analyses including CD3.23 PTE score analysis (using internal PTE algorithm v12) and structural analysis. Structural considerations included: possible contact disruption, anticipated steric clashes, side chain charge maintenance and possible pockets filling. Stability and affinity of the individually expressed molecules in the form of crude lysate was evaluated by Octet (ForteBio).

Figure 6:
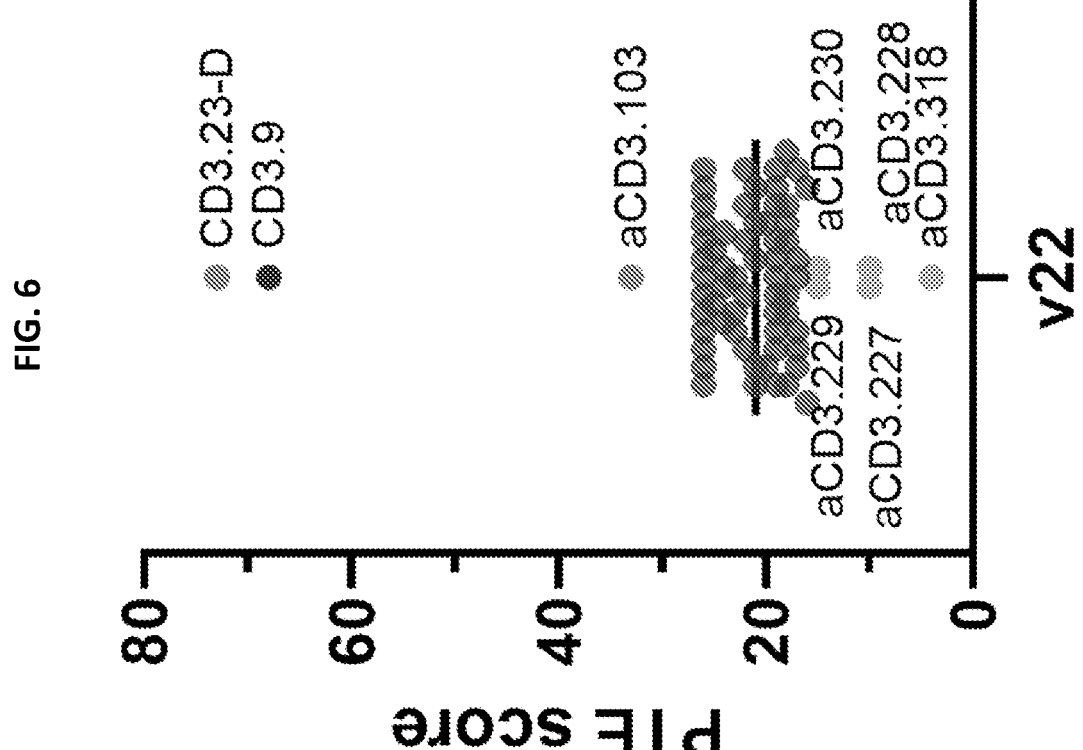
FIG. 6 depicts PTE score evaluations using internal PTE algorithm v22 for anti-CD3 antibody fragments.

Based on the results of the Pool 1 screening, mutations that did not disrupt paTCE molecule affinity and stability were taken further to evaluate as combinations in Pool 2. Pool 2 consisted of paTCE molecules each containing an anti-PSMA VHH and one of 64 CD3.23 mutation combination variants. The amino acid sequences of each of the 64 CD3.23 mutation combination variants are provided in Table 19. Stability and affinity of the individually expressed molecules in the form of crude lysate was evaluated by Octet. The four most stable paTCE molecules from Pool 2 were additionally expressed in a larger volume (2.5 L) and purified. The binding of these anti-CD3 molecules (CD3.227, CD3.228, CD3.229 and CD3.230) to human and cynomolgus CD3 was measured by Octet and the Tm was measured by Differential Scanning Fluorimetry. All variants were paired with an anti-PSMA VHH. Values are reported below in Table 16. Based on these data that included an additional PTE score evaluation using internal PTE algorithm v22 (FIG. 6), CD3.228 was chosen from Pool 2 over the other leads in Table 19.

TABLE 16

| | | | | | | | | |
|---|---|---|---|---|---|---|---|---|
| | Binding affinities, melting temperatures, and PTE values for select CD3 antibodies from Pool 2 | | | | | | | |
| Anti-CD3 scFv | $K_D$, huCD3e-Fc | kon (1/Ms), huCD3e-Fc | kdiss (1/s), huCD3e-Fc | $K_D$, cyCD3e-Fc | kon (1/Ms), cyCD3e-Fc | kdiss (1/s), cyCD3e-Fc | PTE score (v22) | Tm (° C.) |
| CD3.227 | 57 nM | 3.42E+05 | 1.96E−02 | 80 nM | 3.15E+05 | 2.53E−02 | 10 | 63.71 |
| CD3.228 | 69 nM | 3.17E+05 | 2.17E−02 | 80 nM | 3.34E+05 | 2.66E−02 | 10 | 64.45 |
| CD3.229 | 162 nM | 3.21E+05 | 5.20E−02 | 193 nM | 3.17E+05 | 6.11E−02 | 15 | 63.46 |
| CD3.230 | 195 nM | 3.25E+05 | 6.33E−02 | 216 nM | 3.36E+05 | 7.26E−02 | 15 | 63.71 |
| CD3.23 | 131 nM | 2.20E+05 | 2.89E−02 | 130 nM | 2.40E+05 | 3.12E−02 | 73 | 62.62 |

PTE score analysis of the top molecules from Pool 2 (CD3.228, CD3.229 and CD3.230) was performed using PTE algorithm v12. Lowering PTE score mutations were chosen to address potential immunogenicity of two peptide clusters in VH and one peptide cluster in VL. Stability enhancing mutations from Pool 1 (L67D and G68E) were incorporated in the Pool 3 design. Mutations, that potentially detune CD3 binding affinity, were also tested: mutations in CDR-H3 (N100A or S100A) and mutations that detuned CD3 binding as demonstrated in Pool 1 (W47D, V48G, K52bP, A56T, Y58T, Y59D, Y59W). In total-69 new combinations of mutations in the context of single CD3 domain having a 144 amino acid C-terminal ELNN mask, a 144 amino acid N-terminal ELNN mask, and without a tumor binder were evaluated for anti-CD3 binding affinity, stability, and immunogenicity risk. Based on the expression, binding, and stability data two anti-CD3 domains (CD3.295 and CD3.318) were expressed in a larger volume and purified. The binding of these anti-CD3 molecules to human CD3 was measured by Octet and the stability was measured by Differential Scanning Fluorimetry. Values are reported below in Table 17. The CD3.318 scFv was chosen to be combined with anti-EGFR for AMX-525 because of its low immunogenicity risk as determined by internal PTE algorithm v22 (FIG. 6) and increased stability relative to either CD3.23 or CD3.295.

TABLE 17

| Binding affinities, stability, and PTE values for select CD3 antibodies from Pool 3 | | | | |
|---|---|---|---|---|
| AC# | Anti-CD3 scFv | $K_D$ (nM) | PTE score (v22) | % remaining stability |
| AC3796 | CD3.292* | 3.89 | 10 | n.d. |
| AC3799 | CD3.295 | 3.11 | 3 | 73.85% |

TABLE 17-continued

| Binding affinities, stability, and PTE values for select CD3 antibodies from Pool 3 | | | | |
|---|---|---|---|---|
| AC# | Anti-CD3 scFv | $K_D$ (nM) | PTE score (v22) | % remaining stability |
| AC3822 | CD3.318 | 5.38 | 4 | 85.02% |
| AC3768 | CD3.23 | 4.67 | n.d. | 66.11% |

*Clone CD3.292 is identical to CD3.228 but produced as a 144/144 masked scFv without tumor binder
n.d. = no data An alignment of parental CD3.8, CD3.9, and CD3.23 and selected CD3.228 and CD3.318 VL and VH molecules with differences highlighted is provided below. CD3.8 and CD3.9 are humanized versions of the SP34 monoclonal mouse antibody. CD3.23 has 8 mutations compared to CD3.9 and has an estimated 2-4 fold lower affinity vs CD3.9 based on ELISA, Octet, and cell binding data. CD3.228 has 8 mutations compared to CD3.23 and 16 mutations compared to CD3.9. CD3.228 has increased stability and lower immunogenicity risk compared to CD3.23. CD3.318 has increased stability and lower immunogenicity risk as compared to CD3.23.

```
>CD3.8_VL
QAVVTQEPSLTVSPGGTVTLTCGSSTGAVTTSNYANWVQQKPGQAPRGLIGGTNKRAPGVPARF
SGSLLGGKAALTLSGAQPEDEAEYYCALWYSNLWVFGGGTKLTVL (SEQ ID NO: 358)

>CD3.9_VL
ELVVTQEPSLTVSPGGTVTLTCRSSTGAVTTSNYANWVQQKPGQAPRGLIGGTNKRAPGTPARFS
GSLLGGKAALTLSGVQPEDEAEYYCALWYSNLWVFGGGTKLTVL (SEQ ID NO: 359)

>CD3.23_VL
ELVVTQEPSLTVSPGGTVTLTCRSSNGAVTSSNYANWVQQKPGQAPRGLIGGTNKRAPGTPARFS
GSLLGGKAALTLSGVQPEDEAVYYCALWYPNLWVFGGGTKLTVL (SEQ ID NO: 361)

>CD3.228_VL
ELVVTQEPSLTVSPGGTVTLTCRSSNGAVTSSNYANWVQQKPGQAPRGLIGGTNKRAPGTPARFS
GSLLGGKAALTLSGVQPEDEAVYYCALWYPNLWVFGGGTKLTVL (SEQ ID NO: 361)

>CD3.318_VL
ELVVTQEPSLTVSPGGTVTLTCRSSNGAVTSSNYANWVQQKPGQAPRGLIGGTNKRAPGTPARFS
GSLLEGKAALTLSGVQPEDEAVYYCALWYPNLWVFGGGTKLTVL (SEQ ID NO: 127)

CD3.8_VL      QAVVTQEPSLTVSPGGTVTLTCGSSTGAVTTSNYANWVQQKPGQAPRGLIGGTNKRAPGV    60

CD3.9_VL      ELVVTQEPSLTVSPGGTVTLTCRSSTGAVTTSNYANWVQQKPGQAPRGLIGGTNKRAPGT    60

CD3.23_VL     ELVVTQEPSLTVSPGGTVTLTCRSSNGAVTSSNYANWVQQKPGQAPRGLIGGTNKRAPGT    60

CD3.228_VL    ELVVTQEPSLTVSPGGTVTLTCRSSNGAVTSSNYANWVQQKPGQAPRGLIGGTNKRAPGT    60

CD3.318_VL    ELVVTQEPSLTVSPGGTVTLTCRSSNGAVTSSNYANWVQQKPGQAPRGLIGGTNKRAPGT    60
              : ****************** **.****:***************************** .

CD3.8_VL      PARFSGSLLGGKAALTLSGAQPEDEAEYYCALWYSNLWVFGGGTKHTVL              109
              (SEQ ID NO: 358)

CD3.9_VL      PARFSGSLLGGKAALTLSGVQPEDEAEYYCALWYSNLWVFGGGTKHTVL             109
              (SEQ ID NO: 108)

CD3.23_VL     PARFSGSLLGGKAALTLSGVQPEDEAVYYCALWYPNLWVFGGGTKHTVL             109
              (SEQ ID NO: 101)

CD3.228_VL    PARFSGSLLGGKAALTLSGVQPEDEAVYYCALWYPNLWVFGGGTKHTVL             109
              (SEQ ID NO: 101)

CD.318_VL     PARFSGSLLEGKAALTLSGVQPEDEAVYYCALWYPNLWVFGGGTKHTVL             109
              (SEQ ID NO: 127)
              ******** *********.****** ******* **************
Bold: mutations relative to CD3.8

>CD3.8_VH
EVQLVESGGGLVQPGGSLRLSCAASGFTFNTYAMNWVRQAPGKGLEWVGRIRSKYNNYATYY
ADSVKGRFTISRDDSKNTLYLQMNSLREADTAVYYCVRHGNFGNSYVSWFAYWGQGTLVTVSS
(SEQ ID NO: 308)
```

-continued

```
>CD3.9_VH
EVQLVESGGGLVQPGGSLRLSCAASGFTFNTYAMNWVRQAPGKGLEWVGRIRSKYNNYATYY
ADSVKDRFTISRDDSKNTAYLQMNNLKTEDTAVYYCVRHGNFGNSYVSWFAYWGQGTLVTVS
S (SEQ ID NO: 309)

>CD3.23_VH
EVQLLESGGGIVQPGGSLKLSCAASGFTFNTYAMNWVRQAPGKGLEWVARIRSKYNNYATYYA
DSVKDRFTISRDDSKNTVYLQMNNLKTEDTAVYYCVRHENFGNSYVSWFAHWGQGTLVTVSS
(SEQ ID NO: 102)

>CD3.228_VH
EVQLVESGGGIVQPGGSLRLSCAASGFTFSTYAMNWVRQAPGKGLEWVGRIRTKRNNYATYYA
DSVKGRFTISRDDSKNTVYLQMNSLKTEDTAVYYCVRHENFGNSYVSWFAHWGQGTLVTVSS
(SEQ ID NO: 311)

>CD3.318_VH
EVQLVESGGGIVQPGGSLRLSCAASGFTFSTYAMNWVRQAPGKGLEWVGRIRTKRNDYATYYA
DSVKGRFTISRDDSKNTLYLQMNSLKTEDTAVYYCVRHENFGNSYVSWFAHWGQGTLVTVSS
(SEQ ID NO: 126)

CD3.8_VH      EVQLVESGGGLVQPGGSLRLSCAASGFTFNTYAMNWVRQAPGKGLEWVGRIRSKYNNYAT     60

CD3.9_VH      EVQLLESGGGLVQPGGSLKLSCAASGFTFNTYAMNWVRQAPGKGLEWVARIRSKYNNYAT     60

CD3.23_VH     EVQLLESGGGIVQPGGSLKLSCAASGFTFNTYAMNWVRQAPGKGLEWVARIRSKYNNYAT     60

CD3.228_VH    EVQLVESGGGIVQPGGSLRLSCAASGFTFSTYAMNWVRQAPGKGLEWVGRIRTKRNNYAT     60

CD3.318_VH    EVQLVESGGGIVQPGGSLRLSCAASGFTFSTYAMNWVRQAPGKGLEWVGRIRTKRNDYAT     60
              ****:*****:*******:********** ******************.***:* *:***

CD3.8_VH      YYADSVKGRFTISRDDSKNTLYLQMNSLRAEDTAVYYCVRHGNFGNSYVSWFAYWGQGTL     120

CD3.9_VH      YYADSVKDRFTISRDDSKNTAYLQMNNLKTEDTAVYYCVRHGNFGNSYVSWFAYWGQGTL     120

CD3.23_VH     YYADSVKDRFTISRDDSKNTVYLQMNNLKTEDTAVYYCVRHENFGNSYVSWFAHWGQGTL     120

CD3.228_VH    YYADSVKGRFTISRDDSKNTVYLQMNSLKTEDTAVYYCVRHENFGNSYVSWFAHWGQGTL     120

CD3.318_VH    YYADSVKGRFTISRDDSKNTLYLQMNSLKTEDTAVYYCVRHENFGNSYVSWFAHWGQGTL     120
              *******.************ *****.*::*********** ***********:******

CD3.8_VH      VTVSS                                                          125
              (SEQ ID NO: 308)

CD3.9_VH      VTVSS                                                          125
              (SEQ ID NO: 109)

CD3.23_VH     VTVSS                                                          125
              (SEQ ID NO: 102)

CD3.228_VH    VTVSS                                                          125
              (SEQ ID NO: 311)

CD3.318_VH    VTVSS                                                          125
              (SEQ ID NO: 126)
              *****
```

Bold: mutations relative to CD3.8
Bold, underlined: PTE removal mutations
Bold, double underlined: mutations relative to CD3.8 and PTE removal mutations

TABLE 18

Pool 1 CD3.23 Mutation Variants

| AC | VL sequence | VL SEQ ID NO: | VH sequence | VH SEQ ID NO: |
|---|---|---|---|---|
| AC3364 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 834 | EVQLLESGGGIVQPGGSLKLSCAASGF TFNTYAMNWVRQAPGKGLEWVARIR SKYNNYATYYADSVKDRFTISRDDSK NTVYLQMNNLKTEDTAVYYCVRHEN FGNSYVSWFAHWGQGTLVTVSS | 835 |

TABLE 18-continued

Pool 1 CD3.23 Mutation Variants

AC3366 ELVVTQEPSLTVSPGGTVTLTCRSS 836   EVQLLESGGGIVQPGGSLKLSCAASGF 837
      NGAVTSSNYANWVQQKPGQAPR          TFNTYAMNWVRQAPGKGLEWVARIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3367 ELVVTQEPSLTVSPGGTVTLTCRSS 838   EVQLLESGGGIVQPGGSLKLSCAASGF 839
      NGAVTSSNYANWVQQKPGQAPR          TFNTYAMNWVRQAPGKGLEDVARIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3368 ELVVTQEPSLTVSPGGTVTLTCRSS 840   EVQLLESGGGIVQPGGSLKLSCAASGF 841
      NGAVTSSNYANWVQQKPGQAPR          TFNTYAMNWVRQAPGKGLEEVARIRS
      GLIGGTNKRAPGTPARFSGSLLGG       KYNNYATYYADSVKDRFTISRDDSKN
      KAALTLSGVQPEDEAVYYCALWY        TVYLQMNNLKTEDTAVYYCVRHENF
      PNLWVFGGGTKLTVL                  GNSYVSWFAHWGQGTLVTVSS

AC3369 ELVVTQEPSLTVSPGGTVTLTCRSS 842   EVQLLESGGGIVQPGGSLKLSCAASGF 843
      NGAVTSSNYANWVQQKPGQAPR          TFNTYAMNWVRQAPGKGLEWAARIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3370 ELVVTQEPSLTVSPGGTVTLTCRSS 844   EVQLLESGGGIVQPGGSLKLSCAASGF 845
      NGAVTSSNYANWVQQKPGQAPR          TFNTYAMNWVRQAPGKGLEWEARIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3371 ELVVTQEPSLTVSPGGTVTLTCRSS 846   EVQLLESGGGIVQPGGSLKLSCAASGF 847
      NGAVTSSNYANWVQQKPGQAPR          TFNTYAMNWVRQAPGKGLEWGARIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3372 ELVVTQEPSLTVSPGGTVTLTCRSS 848   EVQLLESGGGIVQPGGSLKLSCAASGF 849
      NGAVTSSNYANWVQQKPGQAPR          TFNTYAMNWVRQAPGKGLEWSARIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3373 ELVVTQEPSLTVSPGGTVTLTCRSS 850   EVQLLESGGGIVQPGGSLKLSCAASGF 851
      NGAVTSSNYANWVQQKPGQAPR          TFNTYAMNWVRQAPGKGLEWTARIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3374 ELVVTQEPSLTVSPGGTVTLTCRSS 852   EVQLLESGGGIVQPGGSLKLSCAASGF 853
      NGAVTSSNYANWVQQKPGQAPR          TFNTYAMNWVRQAPGKGLEWWARIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3375 ELVVTQEPSLTVSPGGTVTLTCRSS 854   EVQLLESGGGIVQPGGSLKLSCAASGF 855
      NGAVTSSNYANWVQQKPGQAPR          TFNTYAMNWVRQAPGKGLEWVDRIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3376 ELVVTQEPSLTVSPGGTVTLTCRSS 856   EVQLLESGGGIVQPGGSLKLSCAASGF 857
      NGAVTSSNYANWVQQKPGQAPR          TFNTYAMNWVRQAPGKGLEWVERIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3377 ELVVTQEPSLTVSPGGTVTLTCRSS 858   EVQLLESGGGIVQPGGSLKLSCAASGF 859
      NGAVTSSNYANWVQQKPGQAPR          TFNTYAMNWVRQAPGKGLEWVGRIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

AC3378 ELVVTQEPSLTVSPGGTVTLTCRSS 860   EVQLLESGGGIVQPGGSLKLSCAASGF 861
      NGAVTSSNYANWVQQKPGQAPR          TFNTYAMNWVRQAPGKGLEWVAQIR
      GLIGGTNKRAPGTPARFSGSLLGG       SKYNNYATYYADSVKDRFTISRDDSK
      KAALTLSGVQPEDEAVYYCALWY        NTVYLQMNNLKTEDTAVYYCVRHEN
      PNLWVFGGGTKLTVL                  FGNSYVSWFAHWGQGTLVTVSS

TABLE 18-continued

Pool 1 CD3.23 Mutation Variants

AC3379 ELVVTQEPSLTVSPGGTVTLTCRSS 862    EVQLLESGGGIVQPGGSLKLSCAASGF 863
       NGAVTSSNYANWVQQKPGQAPR              TFNTYAMNWVRQAPGKGLEWVAGIR
       GLIGGTNKRAPGTPARFSGSLLGG           SKYNNYATYYADSVKDRFTISRDDSK
       KAALTLSGVQPEDEAVYYCALWY            NTVYLQMNNLKTEDTAVYYCVRHEN
       PNLWVFGGGTKLTVL                    FGNSYVSWFAHWGQGTLVTVSS

AC3380 ELVVTQEPSLTVSPGGTVTLTCRSS 864    EVQLLESGGGIVQPGGSLKLSCAASGF 865
       NGAVTSSNYANWVQQKPGQAPR              TFNTYAMNWVRQAPGKGLEWVAHIR
       GLIGGTNKRAPGTPARFSGSLLGG           SKYNNYATYYADSVKDRFTISRDDSK
       KAALTLSGVQPEDEAVYYCALWY            NTVYLQMNNLKTEDTAVYYCVRHEN
       PNLWVFGGGTKLTVL                    FGNSYVSWFAHWGQGTLVTVSS

AC3381 ELVVTQEPSLTVSPGGTVTLTCRSS 866    EVQLLESGGGIVQPGGSLKLSCAASGF 867
       NGAVTSSNYANWVQQKPGQAPR              TFNTYAMNWVRQAPGKGLEWVAPIR
       GLIGGTNKRAPGTPARFSGSLLGG           SKYNNYATYYADSVKDRFTISRDDSK
       KAALTLSGVQPEDEAVYYCALWY            NTVYLQMNNLKTEDTAVYYCVRHEN
       PNLWVFGGGTKLTVL                    FGNSYVSWFAHWGQGTLVTVSS

AC3382 ELVVTQEPSLTVSPGGTVTLTCRSS 868    EVQLLESGGGIVQPGGSLKLSCAASGF 869
       NGAVTSSNYANWVQQKPGQAPR              TFNTYAMNWVRQAPGKGLEWVAWI
       GLIGGTNKRAPGTPARFSGSLLGG           RSKYNNYATYYADSVKDRFTISRDDS
       KAALTLSGVQPEDEAVYYCALWY            KNTVYLQMNNLKTEDTAVYYCVRHE
       PNLWVFGGGTKLTVL                    NFGNSYVSWFAHWGQGTLVTVSS

AC3383 ELVVTQEPSLTVSPGGTVTLTCRSS 870    EVQLLESGGGIVQPGGSLKLSCAASGF 871
       NGAVTSSNYANWVQQKPGQAPR              TFNTYAMNWVRQAPGKGLEWVARA
       GLIGGTNKRAPGTPARFSGSLLGG           RSKYNNYATYYADSVKDRFTISRDDS
       KAALTLSGVQPEDEAVYYCALWY            KNTVYLQMNNLKTEDTAVYYCVRHE
       PNLWVFGGGTKLTVL                    NFGNSYVSWFAHWGQGTLVTVSS

AC3384 ELVVTQEPSLTVSPGGTVTLTCRSS 872    EVQLLESGGGIVQPGGSLKLSCAASGF 873
       NGAVTSSNYANWVQQKPGQAPR              TFNTYAMNWVRQAPGKGLEWVARG
       GLIGGTNKRAPGTPARFSGSLLGG           RSKYNNYATYYADSVKDRFTISRDDS
       KAALTLSGVQPEDEAVYYCALWY            KNTVYLQMNNLKTEDTAVYYCVRHE
       PNLWVFGGGTKLTVL                    NFGNSYVSWFAHWGQGTLVTVSS

AC3385 ELVVTQEPSLTVSPGGTVTLTCRSS 874    EVQLLESGGGIVQPGGSLKLSCAASGF 875
       NGAVTSSNYANWVQQKPGQAPR              TFNTYAMNWVRQAPGKGLEWVART
       GLIGGTNKRAPGTPARFSGSLLGG           RSKYNNYATYYADSVKDRFTISRDDS
       KAALTLSGVQPEDEAVYYCALWY            KNTVYLQMNNLKTEDTAVYYCVRHE
       PNLWVFGGGTKLTVL                    NFGNSYVSWFAHWGQGTLVTVSS

AC3386 ELVVTQEPSLTVSPGGTVTLTCRSS 876    EVQLLESGGGIVQPGGSLKLSCAASGF 877
       NGAVTSSNYANWVQQKPGQAPR              TFNTYAMNWVRQAPGKGLEWVARIN
       GLIGGTNKRAPGTPARFSGSLLGG           SKYNNYATYYADSVKDRFTISRDDSK
       KAALTLSGVQPEDEAVYYCALWY            NTVYLQMNNLKTEDTAVYYCVRHEN
       PNLWVFGGGTKLTVL                    FGNSYVSWFAHWGQGTLVTVSS

AC3387 ELVVTQEPSLTVSPGGTVTLTCRSS 878    EVQLLESGGGIVQPGGSLKLSCAASGF 879
       NGAVTSSNYANWVQQKPGQAPR              TFNTYAMNWVRQAPGKGLEWVARID
       GLIGGTNKRAPGTPARFSGSLLGG           SKYNNYATYYADSVKDRFTISRDDSK
       KAALTLSGVQPEDEAVYYCALWY            NTVYLQMNNLKTEDTAVYYCVRHEN
       PNLWVFGGGTKLTVL                    FGNSYVSWFAHWGQGTLVTVSS

AC3388 ELVVTQEPSLTVSPGGTVTLTCRSS 880    EVQLLESGGGIVQPGGSLKLSCAASGF 881
       NGAVTSSNYANWVQQKPGQAPR              TFNTYAMNWVRQAPGKGLEWVARIE
       GLIGGTNKRAPGTPARFSGSLLGG           SKYNNYATYYADSVKDRFTISRDDSK
       KAALTLSGVQPEDEAVYYCALWY            NTVYLQMNNLKTEDTAVYYCVRHEN
       PNLWVFGGGTKLTVL                    FGNSYVSWFAHWGQGTLVTVSS

AC3389 ELVVTQEPSLTVSPGGTVTLTCRSS 882    EVQLLESGGGIVQPGGSLKLSCAASGF 883
       NGAVTSSNYANWVQQKPGQAPR              TFNTYAMNWVRQAPGKGLEWVARIQ
       GLIGGTNKRAPGTPARFSGSLLGG           SKYNNYATYYADSVKDRFTISRDDSK
       KAALTLSGVQPEDEAVYYCALWY            NTVYLQMNNLKTEDTAVYYCVRHEN
       PNLWVFGGGTKLTVL                    FGNSYVSWFAHWGQGTLVTVSS

AC3390 ELVVTQEPSLTVSPGGTVTLTCRSS 884    EVQLLESGGGIVQPGGSLKLSCAASGF 885
       NGAVTSSNYANWVQQKPGQAPR              TFNTYAMNWVRQAPGKGLEWVARIG
       GLIGGTNKRAPGTPARFSGSLLGG           SKYNNYATYYADSVKDRFTISRDDSK
       KAALTLSGVQPEDEAVYYCALWY            NTVYLQMNNLKTEDTAVYYCVRHEN
       PNLWVFGGGTKLTVL                    FGNSYVSWFAHWGQGTLVTVSS

AC3391 ELVVTQEPSLTVSPGGTVTLTCRSS 886    EVQLLESGGGIVQPGGSLKLSCAASGF 887
       NGAVTSSNYANWVQQKPGQAPR              TFNTYAMNWVRQAPGKGLEWVARIH
       GLIGGTNKRAPGTPARFSGSLLGG           SKYNNYATYYADSVKDRFTISRDDSK
       KAALTLSGVQPEDEAVYYCALWY            NTVYLQMNNLKTEDTAVYYCVRHEN
       PNLWVFGGGTKLTVL                    FGNSYVSWFAHWGQGTLVTVSS

TABLE 18-continued

Pool 1 CD3.23 Mutation Variants

```
AC3392  ELVVTQEPSLTVSPGGTVTLTCRSS   888     EVQLLESGGGIVQPGGSLKLSCAASGF   889
        NGAVTSSNYANWVQQKPGQAPR               TFNTYAMNWVRQAPGKGLEWVARI
        GLIGGTNKRAPGTPARFSGSLLGG             WSKYNNYATYYADSVKDRFTISRDDS
        KAALTLSGVQPEDEAVYYCALWY              KNTVYLQMNNLKTEDTAVYYCVRHE
        PNLWVFGGGTKLTVL                      NFGNSYVSWFAHWGQGTLVTVSS

AC3393  ELVVTQEPSLTVSPGGTVTLTCRSS   890     EVQLLESGGGIVQPGGSLKLSCAASGF   891
        NGAVTSSNYANWVQQKPGQAPR               TFNTYAMNWVRQAPGKGLEWVARIR
        GLIGGTNKRAPGTPARFSGSLLGG             NKYNNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3394  ELVVTQEPSLTVSPGGTVTLTCRSS   892     EVQLLESGGGIVQPGGSLKLSCAASGF   893
        NGAVTSSNYANWVQQKPGQAPR               TFNTYAMNWVRQAPGKGLEWVARIR
        GLIGGTNKRAPGTPARFSGSLLGG             DKYNNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3395  ELVVTQEPSLTVSPGGTVTLTCRSS   894     EVQLLESGGGIVQPGGSLKLSCAASGF   895
        NGAVTSSNYANWVQQKPGQAPR               TFNTYAMNWVRQAPGKGLEWVARIR
        GLIGGTNKRAPGTPARFSGSLLGG             EKYNNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3396  ELVVTQEPSLTVSPGGTVTLTCRSS   896     EVQLLESGGGIVQPGGSLKLSCAASGF   897
        NGAVTSSNYANWVQQKPGQAPR               TFNTYAMNWVRQAPGKGLEWVARIR
        GLIGGTNKRAPGTPARFSGSLLGG             TKYNNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3397  ELVVTQEPSLTVSPGGTVTLTCRSS   898     EVQLLESGGGIVQPGGSLKLSCAASGF   899
        NGAVTSSNYANWVQQKPGQAPR               TFNTYAMNWVRQAPGKGLEWVARIR
        GLIGGTNKRAPGTPARFSGSLLGG             SPYNNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3398  ELVVTQEPSLTVSPGGTVTLTCRSS   900     EVQLLESGGGIVQPGGSLKLSCAASGF   901
        NGAVTSSNYANWVQQKPGQAPR               TFNTYAMNWVRQAPGKGLEWVARIR
        GLIGGTNKRAPGTPARFSGSLLGG             SKANNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3399  ELVVTQEPSLTVSPGGTVTLTCRSS   902     EVQLLESGGGIVQPGGSLKLSCAASGF   903
        NGAVTSSNYANWVQQKPGQAPR               TFNTYAMNWVRQAPGKGLEWVARIR
        GLIGGTNKRAPGTPARFSGSLLGG             SKRNNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3400  ELVVTQEPSLTVSPGGTVTLTCRSS   904     EVQLLESGGGIVQPGGSLKLSCAASGF   905
        NGAVTSSNYANWVQQKPGQAPR               TFNTYAMNWVRQAPGKGLEWVARIR
        GLIGGTNKRAPGTPARFSGSLLGG             SKGNNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3401  ELVVTQEPSLTVSPGGTVTLTCRSS   906     EVQLLESGGGIVQPGGSLKLSCAASGF   907
        NGAVTSSNYANWVQQKPGQAPR               TFNTYAMNWVRQAPGKGLEWVARIR
        GLIGGTNKRAPGTPARFSGSLLGG             SKKNNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3402  ELVVTQEPSLTVSPGGTVTLTCRSS   908     EVQLLESGGGIVQPGGSLKLSCAASGF   909
        NGAVTSSNYANWVQQKPGQAPR               TFNTYAMNWVRQAPGKGLEWVARIR
        GLIGGTNKRAPGTPARFSGSLLGG             SKPNNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3403  ELVVTQEPSLTVSPGGTVTLTCRSS   910     EVQLLESGGGIVQPGGSLKLSCAASGF   911
        NGAVTSSNYANWVQQKPGQAPR               TFNTYAMNWVRQAPGKGLEWVARIR
        GLIGGTNKRAPGTPARFSGSLLGG             SKINNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS

AC3404  ELVVTQEPSLTVSPGGTVTLTCRSS   912     EVQLLESGGGIVQPGGSLKLSCAASGF   913
        NGAVTSSNYANWVQQKPGQAPR               TFNTYAMNWVRQAPGKGLEWVARIR
        GLIGGTNKRAPGTPARFSGSLLGG             SKWNNYATYYADSVKDRFTISRDDSK
        KAALTLSGVQPEDEAVYYCALWY              NTVYLQMNNLKTEDTAVYYCVRHEN
        PNLWVFGGGTKLTVL                      FGNSYVSWFAHWGQGTLVTVSS
```

TABLE 18-continued

Pool 1 CD3.23 Mutation Variants

AC3405 ELVVTQEPSLTVSPGGTVTLTCRSS 914  EVQLLESGGGIVQPGGSLKLSCAASGF 915
       NGAVTSSNYANWVQQKPGQAPR            TFNTYAMNWVRQAPGKGLEWVARIR
       GLIGGTNKRAPGTPARFSGSLLGG          SKYDNYATYYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3406 ELVVTQEPSLTVSPGGTVTLTCRSS 916  EVQLLESGGGIVQPGGSLKLSCAASGF 917
       NGAVTSSNYANWVQQKPGQAPR            TFNTYAMNWVRQAPGKGLEWVARIR
       GLIGGTNKRAPGTPARFSGSLLGG          SKYENYATYYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3407 ELVVTQEPSLTVSPGGTVTLTCRSS 918  EVQLLESGGGIVQPGGSLKLSCAASGF 919
       NGAVTSSNYANWVQQKPGQAPR            TFNTYAMNWVRQAPGKGLEWVARIR
       GLIGGTNKRAPGTPARFSGSLLGG          SKYNDYATYYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3408 ELVVTQEPSLTVSPGGTVTLTCRSS 920  EVQLLESGGGIVQPGGSLKLSCAASGF 921
       NGAVTSSNYANWVQQKPGQAPR            TFNTYAMNWVRQAPGKGLEWVARIR
       GLIGGTNKRAPGTPARFSGSLLGG          SKYNEYATYYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3409 ELVVTQEPSLTVSPGGTVTLTCRSS 922  EVQLLESGGGIVQPGGSLKLSCAASGF 923
       NGAVTSSNYANWVQQKPGQAPR            TFNTYAMNWVRQAPGKGLEWVARIR
       GLIGGTNKRAPGTPARFSGSLLGG          SKYNNGATYYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3410 ELVVTQEPSLTVSPGGTVTLTCRSS 924  EVQLLESGGGIVQPGGSLKLSCAASGF 925
       NGAVTSSNYANWVQQKPGQAPR            TFNTYAMNWVRQAPGKGLEWVARIR
       GLIGGTNKRAPGTPARFSGSLLGG          SKYNNFATYYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3411 ELVVTQEPSLTVSPGGTVTLTCRSS 926  EVQLLESGGGIVQPGGSLKLSCAASGF 927
       NGAVTSSNYANWVQQKPGQAPR            TFNTYAMNWVRQAPGKGLEWVARIR
       GLIGGTNKRAPGTPARFSGSLLGG          SKYNNWATYYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3412 ELVVTQEPSLTVSPGGTVTLTCRSS 928  EVQLLESGGGIVQPGGSLKLSCAASGF 929
       NGAVTSSNYANWVQQKPGQAPR            TFNTYAMNWVRQAPGKGLEWVARIR
       GLIGGTNKRAPGTPARFSGSLLGG          SKYNNYGTYYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3413 ELVVTQEPSLTVSPGGTVTLTCRSS 930  EVQLLESGGGIVQPGGSLKLSCAASGF 931
       NGAVTSSNYANWVQQKPGQAPR            TFNTYAMNWVRQAPGKGLEWVARIR
       GLIGGTNKRAPGTPARFSGSLLGG          SKYNNYTTYYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3414 ELVVTQEPSLTVSPGGTVTLTCRSS 932  EVQLLESGGGIVQPGGSLKLSCAASGF 933
       NGAVTSSNYANWVQQKPGQAPR            TFNTYAMNWVRQAPGKGLEWVARIR
       GLIGGTNKRAPGTPARFSGSLLGG          SKYNNYATDYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3415 ELVVTQEPSLTVSPGGTVTLTCRSS 934  EVQLLESGGGIVQPGGSLKLSCAASGF 935
       NGAVTSSNYANWVQQKPGQAPR            TFNTYAMNWVRQAPGKGLEWVARIR
       GLIGGTNKRAPGTPARFSGSLLGG          SKYNNYATEYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3416 ELVVTQEPSLTVSPGGTVTLTCRSS 936  EVQLLESGGGIVQPGGSLKLSCAASGF 937
       NGAVTSSNYANWVQQKPGQAPR            TFNTYAMNWVRQAPGKGLEWVARIR
       GLIGGTNKRAPGTPARFSGSLLGG          SKYNNYATTYADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

AC3417 ELVVTQEPSLTVSPGGTVTLTCRSS 938  EVQLLESGGGIVQPGGSLKLSCAASGF 939
       NGAVTSSNYANWVQQKPGQAPR            TFNTYAMNWVRQAPGKGLEWVARIR
       GLIGGTNKRAPGTPARFSGSLLGG          SKYNNYATYDADSVKDRFTISRDDSK
       KAALTLSGVQPEDEAVYYCALWY           NTVYLQMNNLKTEDTAVYYCVRHEN
       PNLWVFGGGTKLTVL                   FGNSYVSWFAHWGQGTLVTVSS

TABLE 18-continued

Pool 1 CD3.23 Mutation Variants

AC3418 ELVVTQEPSLTVSPGGTVTLTCRSS 940     EVQLLESGGGIVQPGGSLKLSCAASGF 941
       NGAVTSSNYANWVQQKPGQAPR             TFNTYAMNWVRQAPGKGLEWVARIR
       GLIGGTNKRAPGTPARFSGSLLGG           SKYNNYATYEADSVKDRFTISRDDSK
       KAALTLSGVQPEDEAVYYCALWY            NTVYLQMNNLKTEDTAVYYCVRHEN
       PNLWVFGGGTKLTVL                     FGNSYVSWFAHWGQGTLVTVSS

AC3419 ELVVTQEPSLTVSPGGTVTLTCRSS 942     EVQLLESGGGIVQPGGSLKLSCAASGF 943
       NGAVTSSNYANWVQQKPGQAPR             TFNTYAMNWVRQAPGKGLEWVARIR
       GLIGGTNKRAPGTPARFSGSLLGG           SKYNNYATYQADSVKDRFTISRDDSK
       KAALTLSGVQPEDEAVYYCALWY            NTVYLQMNNLKTEDTAVYYCVRHEN
       PNLWVFGGGTKLTVL                     FGNSYVSWFAHWGQGTLVTVSS

AC3420 ELVVTQEPSLTVSPGGTVTLTCRSS 944     EVQLLESGGGIVQPGGSLKLSCAASGF 945
       NGAVTSSNYANWVQQKPGQAPR             TFNTYAMNWVRQAPGKGLEWVARIR
       GLIGGTNKRAPGTPARFSGSLLGG           SKYNNYATYGADSVKDRFTISRDDSK
       KAALTLSGVQPEDEAVYYCALWY            NTVYLQMNNLKTEDTAVYYCVRHEN
       PNLWVFGGGTKLTVL                     FGNSYVSWFAHWGQGTLVTVSS

AC3421 ELVVTQEPSLTVSPGGTVTLTCRSS 946     EVQLLESGGGIVQPGGSLKLSCAASGF 947
       NGAVTSSNYANWVQQKPGQAPR             TFNTYAMNWVRQAPGKGLEWVARIR
       GLIGGTNKRAPGTPARFSGSLLGG           SKYNNYATYWADSVKDRFTISRDDSK
       KAALTLSGVQPEDEAVYYCALWY            NTVYLQMNNLKTEDTAVYYCVRHEN
       PNLWVFGGGTKLTVL                     FGNSYVSWFAHWGQGTLVTVSS

AC3422 ELVVTQEPSLTVSPGGTVTLTCRSS 948     EVQLLESGGGIVQPGGSLKLSCAASGF 949
       NGAVTSSNYANWVQQKPGQAPR             TFNTYAMNWVRQAPGKGLEWVARIR
       GLIGGTNKRAPGTPARFSGSLLGG           SKYNNYATYYKDSVKDRFTISRDDSK
       KAALTLSGVQPEDEAVYYCALWY            NTVYLQMNNLKTEDTAVYYCVRHEN
       PNLWVFGGGTKLTVL                     FGNSYVSWFAHWGQGTLVTVSS

AC3423 ELVVTQEPSLTVSPGGTVTLTCRSS 950     EVQLLESGGGIVQPGGSLKLSCAASGF 951
       NGAVTSSNYANWVQQKPGQAPR             TFNTYAMNWVRQAPGKGLEWVARIR
       GLIGGTNKRAPGTPARFSGSLLGG           SKYNNYATYYPDSVKDRFTISRDDSK
       KAALTLSGVQPEDEAVYYCALWY            NTVYLQMNNLKTEDTAVYYCVRHEN
       PNLWVFGGGTKLTVL                     FGNSYVSWFAHWGQGTLVTVSS

AC3424 ELVVTQEPSLTVSPGGTVTLTCRSS 952     EVQLLESGGGIVQPGGSLKLSCAASGF 953
       NGAVTSSNYANWVQQKPGQAPR             TFNTYAMNWVRQAPGKGLEWVARIR
       GLIGGTNKRAPGTPARFSGSLLGG           SKYNNYATYYADSVKGRFTISRDDSK
       KAALTLSGVQPEDEAVYYCALWY            NTVYLQMNNLKTEDTAVYYCVRHEN
       PNLWVFGGGTKLTVL                     FGNSYVSWFAHWGQGTLVTVSS

AC3425 ELVVTQEPSLTVSPGGTVTLTCRSS 954     EVQLLESGGGIVQPGGSLKLSCAASGF 955
       NGAVTSSNYANWVQQKPGQAPR             TFNTYAMNWVRQAPGKGLEWVARIR
       GLIGGTNKRAPGTPARFSGSLLGG           SKYNNYATYYADSVKDRFTISRDDSK
       KAALTLSGVQPEDEAVYYCALWY            NTVDLQMNNLKTEDTAVYYCVRHEN
       PNLWVFGGGTKLTVL                     FGNSYVSWFAHWGQGTLVTVSS

AC3426 ELVVTQEPSLTVSPGGTVTLTCRSS 956     EVQLLESGGGIVQPGGSLKLSCAASGF 957
       NGAVTSSNYANWVQQKPGQAPR             TFNTYAMNWVRQAPGKGLEWVARIR
       GLIGGTNKRAPGTPARFSGSLLGG           SKYNNYATYYADSVKDRFTISRDDSK
       KAALTLSGVQPEDEAVYYCALWY            NTVGLQMNNLKTEDTAVYYCVRHEN
       PNLWVFGGGTKLTVL                     FGNSYVSWFAHWGQGTLVTVSS

AC3427 ELVVTQEPSLTVSPGGTVTLTCRSS 958     EVQLLESGGGIVQPGGSLKLSCAASGF 959
       NGAVTSSNYANWVQQKPGQAPR             TFNTYAMNWVRQAPGKGLEWVARIR
       GLIGGTNKRAPGTPARFSGSLLGG           SKYNNYATYYADSVKDRFTISRDDSK
       KAALTLSGVQPEDEAVYYCALWY            NTVSLQMNNLKTEDTAVYYCVRHEN
       PNLWVFGGGTKLTVL                     FGNSYVSWFAHWGQGTLVTVSS

AC3428 ELVVTQEPSLTVSPGGTVTLTCRSS 960     EVQLLESGGGIVQPGGSLKLSCAASGF 961
       NGAVTSSNYANWVQQKPGQAPR             TFNTYAMNWVRQAPGKGLEWVARIR
       GLIGGTNKRAPGTPARFSGSLLGG           SKYNNYATYYADSVKDRFTISRDDSK
       KAALTLSGVQPEDEAVYYCALWY            NTVYLQMNELKTEDTAVYYCVRHEN
       PNLWVFGGGTKLTVL                     FGNSYVSWFAHWGQGTLVTVSS

AC3429 ELVVTQEPSLTVSPGGTVTLTCRSS 962     EVQLLESGGGIVQPGGSLKLSCAASGF 963
       NGAVTSSNYANWVQQKPGQAPR             TFNTYAMNWVRQAPGKGLEWVARIR
       GLIGGTNKRAPGTPARFSGSLLGG           SKYNNYATYYADSVKDRFTISRDDSK
       KAALTLSGVQPEDEAVYYCALWY            NTVYLQMNQLKTEDTAVYYCVRHEN
       PNLWVFGGGTKLTVL                     FGNSYVSWFAHWGQGTLVTVSS

AC3430 ELVVTQEPSLTVSPGGTVTLTCRSS 964     EVQLLESGGGIVQPGGSLKLSCAASGF 965
       NGAVTSSNYANWVQQKPGQAPR             TFNTYAMNWVRQAPGKGLEWVARIR
       GLIGGTNKRAPGTPARFSGSLLGG           SKYNNYATYYADSVKDRFTISRDDSK
       KAALTLSGVQPEDEAVYYCALWY            NTVYLQMNSLKTEDTAVYYCVRHEN
       PNLWVFGGGTKLTVL                     FGNSYVSWFAHWGQGTLVTVSS

TABLE 18-continued

Pool 1 CD3.23 Mutation Variants

| | | | | |
|---|---|---|---|---|
| AC3431 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 966 | EVQLLESGGGIVQPGGSLKLSCAASGF TFNTYAMNWVRQAPGKGLEWVARIR SKYNNYATYYADSVKDRFTISRDDSK NTVYLQMNYLKTEDTAVYYCVRHEN FGNSYVSWFAHWGQGTLVTVSS | 967 |
| AC3432 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 968 | EVQLLESGGGIVQPGGSLKLSCAASGF TFNTYAMNWVRQAPGKGLEWVGRIR SKYNNGATYYADSVKGRFTISRDDSK NTVYLQMNSLKTEDTAVYYCVRHEN FGNSYVSWFAHWGQGTLVTVSS | 969 |
| AC3433 | ELVVTQEPSLTVSPGGTVTLTCRSS NGAVTSSNYANWVQQKPGQAPR GLIGGTNKRAPGTPARFSGSLQGG KAALTLSGVQPEDEAVYYCALWY PNLWVFGGGTKLTVL | 970 | EVQLLESGGGIVQPGGSLKLSCAASGF TFNTYAMNWVRQAPGKGLEWVARIR SKYNNYATYYADSVKDRFTISRDDSK NTVYLQMNNLKTEDTAVYYCVRHEN FGNSYVSWFAHWGQGTLVTVSS | 971 |
| AC3434 | ELVVTQEPSLTVSPGGTVTLTCRSS NGAVTSSNYANWVQQKPGQAPR GLIGGTNKRAPGTPARFSGSLLEG KAALTLSGVQPEDEAVYYCALWY PNLWVFGGGTKLTVL | 972 | EVQLLESGGGIVQPGGSLKLSCAASGF TFNTYAMNWVRQAPGKGLEWVARIR SKYNNYATYYADSVKDRFTISRDDSK NTVYLQMNNLKTEDTAVYYCVRHEN FGNSYVSWFAHWGQGTLVTVSS | 973 |
| AC3435 | ELVVTQEPSLTVSPGGTVTLTCRSS NGAVTSSNYANWVQQKPGQAPR GLIGGTNKRAPGTPARFSGSLDGG KAALTLSGVQPEDEAVYYCALWY PNLWVFGGGTKLTVL | 974 | EVQLLESGGGIVQPGGSLKLSCAASGF TFNTYAMNWVRQAPGKGLEWVARIR SKYNNYATYYADSVKDRFTISRDDSK NTVYLQMNNLKTEDTAVYYCVRHEN FGNSYVSWFAHWGQGTLVTVSS | 975 |
| AC3436 | ELVVTQEPSLTVSPGGTVTLTCRSS NGAVTSSNYANWVQQKPGQAPR GLIGGTNKRAPGTPARFSGSSLGG KAALTLSGVQPEDEAVYYCALWY PNLWVFGGGTKLTVL | 976 | EVQLLESGGGIVQPGGSLKLSCAASGF TFNTYAMNWVRQAPGKGLEWVARIR SKYNNYATYYADSVKDRFTISRDDSK NTVYLQMNNLKTEDTAVYYCVRHEN FGNSYVSWFAHWGQGTLVTVSS | 977 |
| AC3437 | ELVVTQEPSLTVSPGGTVTLTCRSS NGAVTSSNYANWVQQKPGQAPR GLIGGTNKRAPGTPARFSGSKLGG KAALTLSGVQPEDEAVYYCALWY PNLWVFGGGTKLTVL | 978 | EVQLLESGGGIVQPGGSLKLSCAASGF TFNTYAMNWVRQAPGKGLEWVARIR SKYNNYATYYADSVKDRFTISRDDSK NTVYLQMNNLKTEDTAVYYCVRHEN FGNSYVSWFAHWGQGTLVTVSS | 979 |
| AC3438 | ELVVTQEPSLTVSPGGTVTLTCRSS NGAVTSSNYANWVQQKPGQAPR GLIGGTNKRAPGTPARFSGSNLGG KAALTLSGVQPEDEAVYYCALWY PNLWVFGGGTKLTVL | 980 | EVQLLESGGGIVQPGGSLKLSCAASGF TFNTYAMNWVRQAPGKGLEWVARIR SKYNNYATYYADSVKDRFTISRDDSK NTVYLQMNNLKTEDTAVYYCVRHEN FGNSYVSWFAHWGQGTLVTVSS | 981 |
| AC3439 | ELVVTQEPSLTVSPGGTVTLTCRSS NGAVTSSNYANWVQQKPGQAPR GLIGGTNKRAPGTPARFSGSTLGG KAALTLSGVQPEDEAVYYCALWY PNLWVFGGGTKLTVL | 982 | EVQLLESGGGIVQPGGSLKLSCAASGF TFNTYAMNWVRQAPGKGLEWVARIR SKYNNYATYYADSVKDRFTISRDDSK NTVYLQMNNLKTEDTAVYYCVRHEN FGNSYVSWFAHWGQGTLVTVSS | 983 |

| AC | CD3.23 domain | Mutation | PTE score v12 | Relative Expression (1-lowest expression, 5-highest expression - evaluated by PEG gel electro-phoresis) | Primary $K_D$ (nM) | % Remaining after heating |
|---|---|---|---|---|---|---|
| AC3364 | CD3.23-L7 | WT | 50 | 4 | 8.5 | 56.90% |
| AC3366 | CD3.23-D | WT | 50 | 3 | 14.0 | 28.73% |
| AC3367 | CD3.38 | W47D | 41 | 4 | 40.2 | ND |
| AC3368 | CD3.39 | W47E | 42 | 4 | 18.1 | 0 |
| AC3369 | CD3.40 | V48A | 38 | 4 | 8.3 | 0 |
| AC3370 | CD3.41 | V48E | 38 | 4 | 164.8 | ND |

TABLE 18-continued

Pool 1 CD3.23 Mutation Variants

| | | | | | | |
|---|---|---|---|---|---|---|
| AC3371 | CD3.42 | V48G | 38 | 4 | 71.5 | ND |
| AC3372 | CD3.43 | V48S | 38 | 4 | 11.2 | 0 |
| AC3373 | CD3.44 | V48T | 38 | 4 | 5.7 | 0 |
| AC3374 | CD3.45 | V48W | 40 | 4 | 34270.0 | ND |
| AC3375 | CD3.46 | A49D | 48 | 4 | Weak binding | ND |
| AC3376 | CD3.47 | A49E | 46 | 4 | No binding | ND |
| AC3377 | CD3.48 | A49G | 45 | 4 | 4.5 | 79.06% |
| AC3378 | CD3.49 | R50Q | 39 | 4 | No binding | ND |
| AC3379 | CD3.50 | R50G | 39 | 4 | No binding | ND |
| AC3380 | CD3.51 | R50H | 41 | 4 | No binding | ND |
| AC3381 | CD3.52 | R50P | 39 | 4 | No binding | ND |
| AC3382 | CD3.53 | R50W | 39 | 2 | No binding | ND |
| AC3383 | CD3.54 | I51A | 45 | 2 | 1182.0 | ND |
| AC3384 | CD3.55 | I51G | 42 | 2 | Weak binding | ND |
| AC3385 | CD3.56 | I51T | 44 | 2 | 424.6 | ND |
| AC3386 | CD3.57 | R52N | 39 | 2 | No binding | ND |
| AC3387 | CD3.58 | R52D | 35 | 2 | No binding | ND |
| AC3388 | CD3.59 | R52E | 35 | 2 | No binding | ND |
| AC3389 | CD3.60 | R52Q | 48 | 2 | 434.4 | ND |
| AC3390 | CD3.61 | R52G | 41 | 2 | No binding | ND |
| AC3391 | CD3.62 | R52H | 50 | 2 | No binding | ND |
| AC3392 | CD3.63 | R52W | 42 | 2 | No binding | ND |
| AC3393 | CD3.64 | S52aN | 48 | 2 | Weak binding | ND |
| AC3394 | CD3.65 | S52aD | 42 | 4 | No binding | ND |
| AC3395 | CD3.66 | S52aE | 42 | 4 | No binding | ND |
| AC3396 | CD3.67 | S52aT | 49 | 4 | 4.8 | 60.06% |
| AC3397 | CD3.68 | K52bP | 45 | 4 | 51.0 | ND |
| AC3398 | CD3.69 | Y52cA | 37 | 4 | 11.5 | 14.99% |
| AC3399 | CD3.70 | Y52cR | 38 | 4 | 3.8 | 56.68% |
| AC3400 | CD3.71 | Y52cG | 36 | 4 | 20.1 | 0 |
| AC3401 | CD3.72 | Y52cK | 40 | 4 | 5.1 | 60.72% |
| AC3402 | CD3.73 | Y52cP | 36 | 4 | 33.1 | ND |
| AC3403 | CD3.74 | Y52cT | 36 | 4 | 11.1 | 35.59% |
| AC3404 | CD3.75 | Y52cW | 48 | 4 | 10.5 | 15.25% |
| AC3405 | CD3.76 | N53D | 34 | 4 | No binding | ND |
| AC3406 | CD3.77 | N53E | 34 | 4 | 574.6 | ND |
| AC3407 | CD3.78 | N54D | 37 | 4 | 7.4 | 61.45% |
| AC3408 | CD3.79 | N54E | 42 | 4 | 8.3 | 43.27% |
| AC3409 | CD3.80 | Y55G | 34 | 4 | 11.3 | 0 |

TABLE 18-continued

Pool 1 CD3.23 Mutation Variants

| | | | | | | |
|---|---|---|---|---|---|---|
| AC3410 | CD3.81 | Y55F | 44 | 4 | 6.1 | 23.50% |
| AC3411 | CD3.82 | Y55W | 38 | 4 | 7.8 | 6.79% |
| AC3412 | CD3.83 | A56G | 49 | 4 | 8.2 | 9.14% |
| AC3413 | CD3.84 | A56T | 49 | 4 | 10.7 | 26.45% |
| AC3414 | CD3.85 | Y58D | 35 | 4 | 938.6 | ND |
| AC3415 | CD3.86 | Y58E | 35 | 4 | 183.4 | ND |
| AC3416 | CD3.87 | Y58T | 35 | 4 | 17.9 | 26.86% |
| AC3417 | CD3.88 | Y59D | 42 | 4 | 63.2 | ND |
| AC3418 | CD3.89 | Y59E | 42 | 4 | 9.7 | 0 |
| AC3419 | CD3.90 | Y59Q | 42 | 4 | 7.2 | 0 |
| AC3420 | CD3.91 | Y59G | 42 | 4 | 8.3 | 0 |
| AC3421 | CD3.92 | Y59W | 42 | 4 | 37.2 | ND |
| AC3422 | CD3.93 | A60K | 37 | 4 | 8.0 | 0 |
| AC3423 | CD3.94 | A60P | 35 | 4 | 8.2 | 0 |
| AC3424 | CD3.95 | D65G | 46 | 4 | 5.4 | 47.80% |
| AC3425 | CD3.96 | Y79D | 31 | 4 | 9.8 | 0 |
| AC3426 | CD3.97 | Y79G | 31 | 2 | 121.1 | ND |
| AC3427 | CD3.98 | Y79S | 31 | 4 | 9.6 | 0 |
| AC3428 | CD3.99 | N82bE | 39 | 4 | 5.9 | 39.70% |
| AC3429 | CD3.100 | N82bQ | 40 | 4 | 7.1 | 18.12% |
| AC3430 | CD3.101 | N82bS | 32 | 4 | 4.8 | 4.22% |
| AC3431 | CD3.102 | N82bY | 46 | 4 | 5.2 | 1.66% |
| AC3432 | CD3.103 | A49G, Y52cG, D65G, N82bS | 8 | 4 | 11.4 | 0 |
| AC3433 | CD3.104 | L67Q | 55 | 4 | 4.6 | 59.68% |
| AC3434 | CD3.105 | G68E | 54 | 4 | 4.9 | 70.99% |
| AC3435 | CD3.106 | L67D | 50 | 4 | 6.1 | 43.75% |
| AC3436 | CD3.107 | L66S | 50 | 4 | 7.3 | 0 |
| AC3437 | CD3.108 | L66K | 50 | 4 | 3.2 | 0 |
| AC3438 | CD3.109 | L66N | 50 | 4 | 8.3 | 0 |
| AC3439 | CD3.110 | L66T | 50 | 4 | 8.9 | 0 |

TABLE 19

Pool 2 CD3.23 Mutation Combination Variants

| AC | VL sequence | VL SEQ ID NO: | VH sequence | VH SEQ ID NO: |
|---|---|---|---|---|
| AC3632 | ELVVTQEPSLTVSPGGTVTLTCRSS NGAVTSSNYANWVQQKPGQAPR GLIGGTNKRAPGTPARFSGSLLGG | 700 | EVQLLESGGGIVQPGGSLRLSCAAS GFTFNTYAMNWVRQAPGKGLEWV GRIRSKRNNYATYYADSVKGRFTIS | 701 |

TABLE 19-continued

Pool 2 CD3.23 Mutation Combination Variants

| | KAALTLSGVQPEDEAVYYCALWY PNLWVFGGGTKLTVL | | RDDSKNTVYLQMNSLKTEDTAVYY CVRHENFGNSYVSWFAHWGQGTLV TVSS | |
|---|---|---|---|---|
| AC3633 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 702 | EVQLVESGGGIVQPGGSLRLSCAAS GFTFNTYAMNWVRQAPGKGLEWV GRIRSKRNNYATYYADSVKGRFTIS RDDSKNTVYLQMNSLKTEDTAVYY CVRHENFGNSYVSWFAHWGQGTLV TVSS | 703 |
| AC3634 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 704 | EVQLLESGGGIVQPGGSLRLSCAAS GFTFNTYAMNWVRQAPGKGLEWV GRIRSKINNYATYYADSVKGRFTIS RDDSKNTVYLQMNSLKTEDTAVYY CVRHENFGNSYVSWFAHWGQGTLV TVSS | 705 |
| AC3635 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 706 | EVQLVESGGGIVQPGGSLRLSCAAS GFTFNTYAMNWVRQAPGKGLEWV GRIRSKINNYATYYADSVKGRFTIS RDDSKNTVYLQMNSLKTEDTAVYY CVRHENFGNSYVSWFAHWGQGTLV TVSS | 707 |
| AC3636 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 708 | EVQLLESGGGIVQPGGSLRLSCAAS GFTFNTYAMNWVRQAPGKGLEWV GRIRSKYNDYATYYADSVKGRFTIS RDDSKNTVYLQMNSLKTEDTAVYY CVRHENFGNSYVSWFAHWGQGTLV TVSS | 709 |
| AC3637 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 710 | EVQLVESGGGIVQPGGSLRLSCAAS GFTFNTYAMNWVRQAPGKGLEWV GRIRSKYNDYATYYADSVKGRFTIS RDDSKNTVYLQMNSLKTEDTAVYY CVRHENFGNSYVSWFAHWGQGTLV TVSS | 711 |
| AC3638 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 712 | EVQLLESGGGIVQPGGSLRLSCAAS GFTFNTYAMNWVRQAPGKGLEWV GRIRSKYNNYATTYADSVKGRFTIS RDDSKNTVYLQMNSLKTEDTAVYY CVRHENFGNSYVSWFAHWGQGTLV TVSS | 713 |
| AC3639 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 714 | EVQLVESGGGIVQPGGSLRLSCAAS GFTFNTYAMNWVRQAPGKGLEWV GRIRSKYNNYATTYADSVKGRFTIS RDDSKNTVYLQMNSLKTEDTAVYY CVRHENFGNSYVSWFAHWGQGTLV TVSS | 715 |
| AC3640 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 716 | EVQLVESGGGIVQPGGSLRLSCAAS GFTFNTYAMNWVRQAPGKGLEWV GRIRSKRNNYATYYADSVKGRFTIS RDDSKNTVYLQMNELKTEDTAVYY CVRHENFGNSYVSWFAHWGQGTLV TVSS | 717 |
| AC3641 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 718 | EVQLVESGGGIVQPGGSLRLSCAAS GFTFSTYAMNWVRQAPGKGLEWV GRIRSKRNNYATYYADSVKGRFTIS RDDSKNTVYLQMNELKTEDTAVYY CVRHENFGNSYVSWFAHWGQGTLV TVSS | 719 |
| AC3642 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 720 | EVQLVESGGGIVQPGGSLRLSCAAS GFTFNTYAMNWVRQAPGKGLEWV GRIRSKINNYATYYADSVKGRFTIS RDDSKNTVYLQMNELKTEDTAVYY CVRHENFGNSYVSWFAHWGQGTLV TVSS | 721 |
| AC3643 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY | 722 | EVQLVESGGGIVQPGGSLRLSCAAS GFTFSTYAMNWVRQAPGKGLEWV GRIRSKTNNYATYYADSVKGRFTIS RDDSKNTVYLQMNELKTEDTAVYY | 723 |

TABLE 19-continued

Pool 2 CD3.23 Mutation Combination Variants

|  |  |  |  |  |
|---|---|---|---|---|
|  | PNLWVFGGGTKLTVL |  | CVRHENFGNSYVSWFAHWGQGTLV<br>TVSS |  |
| AC3644 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 724 | EVQLVESGGGIVQPGGSLRLSCAAS<br>GFTFNTYAMNWVRQAPGKGLEWV<br>GRIRSKYNDYATYYADSVKGRFTIS<br>RDDSKNTVYLQMNELKTEDTAVYY<br>CVRHENFGNSYVSWFAHWGQGTLV<br>TVSS | 725 |
| AC3645 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 726 | EVQLVESGGGIVQPGGSLRLSCAAS<br>GFTFSTYAMNWVRQAPGKGLEWV<br>GRIRSKYNDYATYYADSVKGRFTIS<br>RDDSKNTVYLQMNELKTEDTAVYY<br>CVRHENFGNSYVSWFAHWGQGTLV<br>TVSS | 727 |
| AC3646 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 728 | EVQLVESGGGIVQPGGSLRLSCAAS<br>GFTFSTYAMNWVRQAPGKGLEWV<br>GRIRSKRNNYATYYADSVKGRFTIS<br>RDDSKNTVYLQMNSLKTEDTAVYY<br>CVRHENFGNSYVSWFAHWGQGTLV<br>TVSS | 729 |
| AC3647 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 730 | EVQLVESGGGIVQPGGSLRLSCAAS<br>GFTFSTYAMNWVRQAPGKGLEWV<br>GRIRSKTNNYATYYADSVKGRFTIS<br>RDDSKNTVYLQMNSLKTEDTAVYY<br>CVRHENFGNSYVSWFAHWGQGTLV<br>TVSS | 731 |
| AC3648 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 732 | EVQLVESGGGIVQPGGSLRLSCAAS<br>GFTFSTYAMNWVRQAPGKGLEWV<br>GRIRSKYNDYATYYADSVKGRFTIS<br>RDDSKNTVYLQMNSLKTEDTAVYY<br>CVRHENFGNSYVSWFAHWGQGTLV<br>TVSS | 733 |
| AC3649 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 734 | EVQLVESGGGIVQPGGSLRLSCAAS<br>GFTFSTYAMNWVRQAPGKGLEWV<br>GRIRSKYNNYATTYADSVKGRFTIS<br>RDDSKNTVYLQMNSLKTEDTAVYY<br>CVRHENFGNSYVSWFAHWGQGTLV<br>TVSS | 735 |
| AC3650 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 736 | EVQLVESGGGIVQPGGSLRLSCAAS<br>GFTFNTYAMNWVRQAPGKGLEWV<br>GRIRTKRNNYATYYADSVKGRFTIS<br>RDDSKNTVYLQMNELKTEDTAVYY<br>CVRHENFGNSYVSWFAHWGQGTLV<br>TVSS | 737 |
| AC3651 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 738 | EVQLVESGGGIVQPGGSLRLSCAAS<br>GFTFSTYAMNWVRQAPGKGLEWV<br>GRIRTKRNNYATYYADSVKGRFTIS<br>RDDSKNTVYLQMNELKTEDTAVYY<br>CVRHENFGNSYVSWFAHWGQGTLV<br>TVSS | 739 |
| AC3652 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 740 | EVQLVESGGGIVQPGGSLRLSCAAS<br>GFTFNTYAMNWVRQAPGKGLEWV<br>GRIRTKTNNYATYYADSVKGRFTIS<br>RDDSKNTVYLQMNELKTEDTAVYY<br>CVRHENFGNSYVSWFAHWGQGTLV<br>TVSS | 741 |
| AC3653 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 742 | EVQLVESGGGIVQPGGSLRLSCAAS<br>GFTFSTYAMNWVRQAPGKGLEWV<br>GRIRTKTNNYATYYADSVKGRFTIS<br>RDDSKNTVYLQMNELKTEDTAVYY<br>CVRHENFGNSYVSWFAHWGQGTLV<br>TVSS | 743 |
| AC3654 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY | 744 | EVQLVESGGGIVQPGGSLRLSCAAS<br>GFTFNTYAMNWVRQAPGKGLEWV<br>GRIRTKYNDYATYYADSVKGRFTIS<br>RDDSKNTVYLQMNELKTEDTAVYY | 745 |

TABLE 19-continued

Pool 2 CD3.23 Mutation Combination Variants

|  | PNLWVFGGGTKLTVL |  | CVRHENFGNSYVSWFAHWGQGTLV<br>TVSS |  |
|---|---|---|---|---|
| AC3655 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 746 | EVQLVESGGGIVQPGGSLRLSCAAS<br>GFTFSTYAMNWVRQAPGKGLEWV<br>GRIRTKYNDYATYYADSVKGRFTIS<br>RDDSKNTVYLQMNELKTEDTAVYY<br>CVRHENFGNSYVSWFAHWGQGTLV<br>TVSS | 747 |
| AC3656 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 748 | EVQLVESGGGIVQPGGSLRLSCAAS<br>GFTFNTYAMNWVRQAPGKGLEWV<br>GRIRTKYNNYATTYADSVKGRFTIS<br>RDDSKNTVYLQMNELKTEDTAVYY<br>CVRHENFGNSYVSWFAHWGQGTLV<br>TVSS | 749 |
| AC3657 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 750 | EVQLVESGGGIVQPGGSLRLSCAAS<br>GFTFSTYAMNWVRQAPGKGLEWV<br>GRIRTKYNNYATTYADSVKGRFTIS<br>RDDSKNTVYLQMNELKTEDTAVYY<br>CVRHENFGNSYVSWFAHWGQGTLV<br>TVSS | 751 |
| AC3658 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 752 | EVQLVESGGGIVQPGGSLRLSCAAS<br>GFTFNTYAMNWVRQAPGKGLEWV<br>GRIRTKRNNYATYYADSVKGRFTIS<br>RDDSKNTVYLQMNSLKTEDTAVYY<br>CVRHENFGNSYVSWFAHWGQGTLV<br>TVSS | 753 |
| AC3659 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 754 | EVQLVESGGGIVQPGGSLRLSCAAS<br>GFTFSTYAMNWVRQAPGKGLEWV<br>GRIRTKRNNYATYYADSVKGRFTIS<br>RDDSKNTVYLQMNSLKTEDTAVYY<br>CVRHENFGNSYVSWFAHWGQGTLV<br>TVSS | 755 |
| AC3660 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 756 | EVQLVESGGGIVQPGGSLRLSCAAS<br>GFTFNTYAMNWVRQAPGKGLEWV<br>GRIRTKTNNYATYYADSVKGRFTIS<br>RDDSKNTVYLQMNSLKTEDTAVYY<br>CVRHENFGNSYVSWFAHWGQGTLV<br>TVSS | 757 |
| AC3661 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 758 | EVQLVESGGGIVQPGGSLRLSCAAS<br>GFTFSTYAMNWVRQAPGKGLEWV<br>GRIRTKTNNYATYYADSVKGRFTIS<br>RDDSKNTVYLQMNSLKTEDTAVYY<br>CVRHENFGNSYVSWFAHWGQGTLV<br>TVSS | 759 |
| AC3662 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 760 | EVQLVESGGGIVQPGGSLRLSCAAS<br>GFTFNTYAMNWVRQAPGKGLEWV<br>GRIRTKYNDYATYYADSVKGRFTIS<br>RDDSKNTVYLQMNSLKTEDTAVYY<br>CVRHENFGNSYVSWFAHWGQGTLV<br>TVSS | 761 |
| AC3663 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 762 | EVQLVESGGGIVQPGGSLRLSCAAS<br>GFTFSTYAMNWVRQAPGKGLEWV<br>GRIRTKYNDYATYYADSVKGRFTIS<br>RDDSKNTVYLQMNSLKTEDTAVYY<br>CVRHENFGNSYVSWFAHWGQGTLV<br>TVSS | 763 |
| AC3664 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 764 | EVQLVESGGGIVQPGGSLRLSCAAS<br>GFTFNTYAMNWVRQAPGKGLEWV<br>GRIRTKYNNYATTYADSVKGRFTIS<br>RDDSKNTVYLQMNSLKTEDTAVYY<br>CVRHENFGNSYVSWFAHWGQGTLV<br>TVSS | 765 |
| AC3665 | ELVVTQEPSLTVSPGGTVTLTCRSS<br>NGAVTSSNYANWVQQKPGQAPR<br>GLIGGTNKRAPGTPARFSGSLLGG | 766 | EVQLVESGGGIVQPGGSLRLSCAAS<br>GFTFSTYAMNWVRQAPGKGLEWV<br>GRIRTKYNNYATTYADSVKGRFTIS | 767 |

TABLE 19-continued

Pool 2 CD3.23 Mutation Combination Variants

|  |  |  |  |  |
|---|---|---|---|---|
|  | KAALTLSGVQPEDEAVYYCALWY PNLWVFGGGTKLTVL |  | RDDSKNTVYLQMNSLKTEDTAVYY CVRHENFGNSYVSWFAHWGQGTLV TVSS |  |
| AC3666 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 768 | EVQLVESGGGIVQPGGSLRLSCAAS GFTFNTYAMNWVRQAPGKGLEWV GRIRSKYNEYATYYADSVKGRFTIS RDDSKNTVYLQMNSLKTEDTAVYY CVRHENFGNSYVSWFAHWGQGTLV TVSS | 769 |
| AC3667 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 770 | EVQLVESGGGIVQPGGSLRLSCAAS GFTFNTYAMNWVRQAPGKGLEWV GRIRSKYNNGATYYADSVKGRFTIS RDDSKNTVYLQMNSLKTEDTAVYY CVRHENFGNSYVSWFAHWGQGTLV TVSS | 771 |
| AC3668 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 772 | EVQLVESGGGIVQPGGSLRLSCAAS GFTFNTYAMNWVRQAPGKGLEWV GRIRSKYNNGATYYADSVKGRFTIS RDDSKNTVYLQMNELKTEDTAVYY CVRHENFGNSYVSWFAHWGQGTLV TVSS | 773 |
| AC3669 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 774 | EVQLVESGGGIVQPGGSLRLSCAAS GFTFNTYAMNWVRQAPGKGLEWV ARIRTKYNNYATTYADSVKDRFTIS RDDSKNTVYLQMNSLKTEDTAVYY CVRHENFGNSYVSWFAHWGQGTLV TVSS | 775 |
| AC3670 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 776 | EVQLVESGGGIVQPGGSLRLSCAAS GFTFNTYAMNWVRQAPGKGLEWV ARIRSKRNNYATTYADSVKDRFTISR DDSKNTVYLQMNSLKTEDTAVYYC VRHENFGNSYVSWFAHWGQGTLVT VSS | 777 |
| AC3671 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 778 | EVQLVESGGGIVQPGGSLRLSCAAS GFTFNTYAMNWVRQAPGKGLEWV ARIRSKKNNYATTYADSVKDRFTIS RDDSKNTVYLQMNSLKTEDTAVYY CVRHENFGNSYVSWFAHWGQGTLV TVSS | 779 |
| AC3672 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 780 | EVQLVESGGGIVQPGGSLRLSCAAS GFTFNTYAMNWVRQAPGKGLEWV ARIRSKINNYATTYADSVKDRFTISR DDSKNTVYLQMNSLKTEDTAVYYC VRHENFGNSYVSWFAHWGQGTLVT VSS | 781 |
| AC3673 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 782 | EVQLVESGGGIVQPGGSLRLSCAAS GFTFNTYAMNWVRQAPGKGLEWV GRIRSKYNDYATYYADSVKGRFTIS RDDSKNTLYLQMNSLKTEDTAVYY CVRHENFGNSYVSWFAHWGQGTLV TVSS | 783 |
| AC3674 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 784 | EVQLVESGGGIVQPGGSLRLSCAAS GFTFNTYAMNWVRQAPGKGLEWV GRIRSKYNEYATYYADSVKGRFTIS RDDSKNTLYLQMNSLKTEDTAVYY CVRHENFGNSYVSWFAHWGQGTLV TVSS | 785 |
| AC3675 | ELVVTQEPSLTVSPGGTVTLTCRSS NGAVTSSNYANWVQQKPGQAPR GLIGGTNKRAPGTPARFSGSLLGG KAALTLSGVQPEDEAVYYCALWY PNLWVFGGGTKLTVL | 786 | EVQLVESGGGIVQPGGSLRLSCAAS GFTFNTYAMNWVRQAPGKGLEWV GRIRSKYNNGATYYADSVKGRFTIS RDDSKNTLYLQMNSLKTEDTAVYY CVRHENFGNSYVSWFAHWGQGTLV TVSS | 787 |
| AC3676 | ELVVTQEPSLTVSPGGTVTLTCRSS NGAVTSSNYANWVQQKPGQAPR | 788 | EVQLVESGGGIVQPGGSLRLSCAAS GFTFNTYAMNWVRQAPGKGLEWV | 789 |

TABLE 19-continued

Pool 2 CD3.23 Mutation Combination Variants

| | | | | |
|---|---|---|---|---|
| | GLIGGTNKRAPGTPARFSGSLLGG<br>KAALTLSGVQPEDEAVYYCALWY<br>PNLWVFGGGTKLTVL | | GRIRSKYNNGATYYADSVKGRFTIS<br>RDDSKNTLYLQMNELKTEDTAVYY<br>CVRHENFGNSYVSWFAHWGQGTLV<br>TVSS | |
| AC3677 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 790 | EVQLVESGGGIVQPGGSLRLSCAAS<br>GFTFNTYAMNWVRQAPGKGLEWV<br>ARIRTKYNNYATTYADSVKDRFTIS<br>RDDSKNTLYLQMNSLKTEDTAVYY<br>CVRHENFGNSYVSWFAHWGQGTLV<br>TVSS | 791 |
| AC3678 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 792 | EVQLVESGGGIVQPGGSLRLSCAAS<br>GFTFNTYAMNWVRQAPGKGLEWV<br>ARIRSKRNNYATTYADSVKDRFTISR<br>DDSKNTLYLQMNSLKTEDTAVYYC<br>VRHENFGNSYVSWFAHWGQGTLVT<br>VSS | 793 |
| AC3679 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 794 | EVQLVESGGGIVQPGGSLRLSCAAS<br>GFTFNTYAMNWVRQAPGKGLEWV<br>ARIRSKKNNYATTYADSVKDRFTIS<br>RDDSKNTLYLQMNSLKTEDTAVYY<br>CVRHENFGNSYVSWFAHWGQGTLV<br>TVSS | 795 |
| AC3680 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 796 | EVQLVESGGGIVQPGGSLRLSCAAS<br>GFTFNTYAMNWVRQAPGKGLEWV<br>ARIRSKINNYATTYADSVKDRFTISR<br>DDSKNTLYLQMNSLKTEDTAVYYC<br>VRHENFGNSYVSWFAHWGQGTLVT<br>VSS | 797 |
| AC3681 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 798 | EVQLVESGGGIVQPGGSLRLSCAAS<br>GFTFNTYAMNWVRQAPGKGLEWV<br>GRIRTKYNNYATTYADSVKDRFTIS<br>RDDSKNTVYLQMNSLKTEDTAVYY<br>CVRHENFGNSYVSWFAHWGQGTLV<br>TVSS | 799 |
| AC3682 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 800 | EVQLVESGGGIVQPGGSLRLSCAAS<br>GFTFNTYAMNWVRQAPGKGLEWV<br>GRIRSKRNNYATTYADSVKDRFTISR<br>DDSKNTVYLQMNSLKTEDTAVYYC<br>VRHENFGNSYVSWFAHWGQGTLVT<br>VSS | 801 |
| AC3683 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 802 | EVQLVESGGGIVQPGGSLRLSCAAS<br>GFTFNTYAMNWVRQAPGKGLEWV<br>GRIRSKKNNYATTYADSVKDRFTIS<br>RDDSKNTVYLQMNSLKTEDTAVYY<br>CVRHENFGNSYVSWFAHWGQGTLV<br>TVSS | 803 |
| AC3684 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 804 | EVQLVESGGGIVQPGGSLRLSCAAS<br>GFTFNTYAMNWVRQAPGKGLEWV<br>GRIRSKINNYATTYADSVKDRFTISR<br>DDSKNTVYLQMNSLKTEDTAVYYC<br>VRHENFGNSYVSWFAHWGQGTLVT<br>VSS | 805 |
| AC3685 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 806 | EVQLVESGGGIVQPGGSLRLSCAAS<br>GFTFNTYAMNWVRQAPGKGLEWV<br>GRIRTKYNNYATTYADSVKDRFTIS<br>RDDSKNTVYLQMNELKTEDTAVYY<br>CVRHENFGNSYVSWFAHWGQGTLV<br>TVSS | 807 |
| AC3686 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 808 | EVQLVESGGGIVQPGGSLRLSCAAS<br>GFTFNTYAMNWVRQAPGKGLEWV<br>GRIRSKRNNYATTYADSVKDRFTISR<br>DDSKNTVYLQMNELKTEDTAVYYC<br>VRHENFGNSYVSWFAHWGQGTLVT<br>VSS | 809 |
| AC3687 | ELVVTQEPSLTVSPGGTVTLTCRSS<br>NGAVTSSNYANWVQQKPGQAPR<br>GLIGGTNKRAPGTPARFSGSLLGG | 810 | EVQLVESGGGIVQPGGSLRLSCAAS<br>GFTFNTYAMNWVRQAPGKGLEWV<br>GRIRSKKNNYATTYADSVKDRFTIS | 811 |

TABLE 19-continued

Pool 2 CD3.23 Mutation Combination Variants

|  | KAALTLSGVQPEDEAVYYCALWY<br>PNLWVFGGGTKLTVL |  | RDDSKNTVYLQMNELKTEDTAVYY<br>CVRHENFGNSYVSWFAHWGQGTLV<br>TVSS |  |
|---|---|---|---|---|
| AC3688 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 812 | EVQLVESGGGIVQPGGSLRLSCAAS<br>GFTFNTYAMNWVRQAPGKGLEWV<br>GRIRSKTNNYATTYADSVKDRFTISR<br>DDSKNTVYLQMNELKTEDTAVYYC<br>VRHENFGNSYVSWFAHWGQGTLVT<br>VSS | 813 |
| AC3689 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 814 | EVQLVESGGGIVQPGGSLRLSCAAS<br>GFTFNTYAMNWVRQAPGKGLEWV<br>GRIRTKYNNYATTYADSVKDRFTIS<br>RDDSKNTLYLQMNSLKTEDTAVYY<br>CVRHENFGNSYVSWFAHWGQGTLV<br>TVSS | 815 |
| AC3690 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 816 | EVQLVESGGGIVQPGGSLRLSCAAS<br>GFTFNTYAMNWVRQAPGKGLEWV<br>GRIRSKRNNYATTYADSVKDRFTISR<br>DDSKNTLYLQMNSLKTEDTAVYYC<br>VRHENFGNSYVSWFAHWGQGTLVT<br>VSS | 817 |
| AC3691 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 818 | EVQLVESGGGIVQPGGSLRLSCAAS<br>GFTFNTYAMNWVRQAPGKGLEWV<br>GRIRSKKNNYATTYADSVKDRFTIS<br>RDDSKNTLYLQMNSLKTEDTAVYY<br>CVRHENFGNSYVSWFAHWGQGTLV<br>TVSS | 819 |
| AC3692 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 820 | EVQLVESGGGIVQPGGSLRLSCAAS<br>GFTFNTYAMNWVRQAPGKGLEWV<br>GRIRSKINNYATTYADSVKDRFTISR<br>DDSKNTLYLQMNSLKTEDTAVYYC<br>VRHENFGNSYVSWFAHWGQGTLVT<br>VSS | 821 |
| AC3693 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 822 | EVQLVESGGGIVQPGGSLRLSCAAS<br>GFTFNTYAMNWVRQAPGKGLEWV<br>GRIRSKRNNYATTYADSVKDRFTISR<br>DDSKNTLYLQMNELKTEDTAVYYC<br>VRHENFGNSYVSWFAHWGQGTLVT<br>VSS | 823 |
| AC3694 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 824 | EVQLVESGGGIVQPGGSLKLSCAAS<br>GFTFNTYAMNWVRQAPGKGLEWV<br>GRIRTKRNNYATYYADSVKGRFTIS<br>RDDSKNTVYLQMNSLKTEDTAVYY<br>CVRHENFGNSYVSWFAHWGQGTLV<br>TVSS | 825 |
| AC3695 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 826 | EVQLVESGGGIVQPGGSLKLSCAAS<br>GFTFSTYAMNWVRQAPGKGLEWV<br>GRIRTKRNNYATYYADSVKGRFTIS<br>RDDSKNTVYLQMNSLKTEDTAVYY<br>CVRHENFGNSYVSWFAHWGQGTLV<br>TVSS | 827 |
| AC3471 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 828 | EVQLLESGGGIVQPGGSLKLSCAAS<br>GFTFNTYAMNWVRQAPGKGLEWV<br>ARIRSKYNNYATYYADSVKDRFTIS<br>RDDSKNTVYLQMNNLKTEDTAVYY<br>CVRHENFGNSYVSWFAHWGQGTLV<br>TVSS | 829 |
| AC3432 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY<br>PNLWVFGGGTKLTVL | 830 | EVQLLESGGGIVQPGGSLKLSCAAS<br>GFTFNTYAMNWVRQAPGKGLEWV<br>GRIRSKYNNGATYYADSVKGRFTIS<br>RDDSKNTVYLQMNSLKTEDTAVYY<br>CVRHENFGNSYVSWFAHWGQGTLV<br>TVSS | 831 |
| AC2717 | ELVVTQEPSLTVSPGGTVTLTCRSS<br>NGAVTSSNYANWVQQKPGQAPR<br>GLIGGTNKRAPGTPARFSGSLLGG<br>KAALTLSGVQPEDEAVYYCALWY | 832 | EVQLLESGGGIVQPGGSLKLSCAAS<br>GFTFNTYAMNWVRQAPGKGLEWV<br>ARIRSKYNNYATYYADSVKDRFTIS<br>RDDSKNTVYLQMNNLKTEDTAVYY | 833 |

TABLE 19-continued

| | | | | | | | |
|---|---|---|---|---|---|---|---|
| Pool 2 CD3.23 Mutation Combination Variants | | | | | | | |
| PNLWVFGGGTKLTVL | | | | | CVRHENFGNSYVSWFAHWGQGTLV TVSS | | |
| AC | CD3.23 domain | Mutation | PTE score v12 | PTE score v22 | Expression Level** | Expression Ratio*** | Primary Screen huCD3e (nM) | % Remaining of stability |
| AC3632 | CD3.201 | K19R, A49G, Y52cR, D65G, N82bS | 9 | 18 | 3050.0 | 1.2 | 8.6 | 55.24% |
| AC3633 | CD3.202 | L5V, K19R, A49G, Y52cR, D65G, N82bS | 9 | 18 | 2220.0 | 0.9 | 8.4 | 60.79% |
| AC3634 | CD3.203 | K19R, A49G, Y52cT, D65G, N82bS | 10 | 19 | ND | ND | ND | ND |
| AC3635 | CD3.204 | L5V, K19R, A49G, Y52cT, D65G, N82bS | 10 | 19 | 1870.0 | 0.8 | 7.2 | 36.92% |
| AC3636 | CD3.205 | K19R, A49G, N54D, D65G, N82bS | 10 | 19 | 3000.0 | 1.2 | 7.2 | 58.50% |
| AC3637 | CD3.206 | L5V, K19R, A49G, N54D, D65G, N82bS | 10 | 19 | 1450.0 | 0.6 | 10.3 | 28.98% |
| AC3638 | CD3.207 | K19R, A49G, Y58T, D65G, N82bS | 12 | 21 | 2420.0 | 1.0 | 15.6 | 1.01% |
| AC3639 | CD3.208 | L5V, K19R, A49G, Y58T, D65G, N82bS | 12 | 21 | 2400.0 | 1.0 | 16.8 | 24.61% |
| AC3640 | CD3.209 | L5V, K19R, A49G, Y52cR, D65G, N82bE | 16 | 25 | 2280.0 | 0.9 | 5.6 | 37.31% |
| AC3641 | CD3.210 | L5V, K19R, N30S, A49G, Y52cR, D65G, N82bE | 16 | 25 | 2120.0 | 0.9 | 5.7 | 69.25% |
| AC3642 | CD3.211 | L5V, K19R, A49G, | 17 | 26 | 2610.0 | 1.1 | 9.5 | 29.37% |

TABLE 19-continued

| | | | | | | | | |
|---|---|---|---|---|---|---|---|---|
| | | Pool 2 CD3.23 Mutation Combination Variants | | | | | | |
| | | Y52cT, D65G, N82bE | | | | | | |
| AC3643 | CD3.212 | L5V, K19R, N30S, A49G, Y52cT, D65G, N82bE | 17 | 26 | 890.0 | 0.4 | 35.6 | 9.81% |
| AC3644 | CD3.213 | L5V, K19R, A49G, N54D, D65G, N82bE | 17 | 26 | 3280.0 | 1.2 | 6.6 | 57.91% |
| AC3645 | CD3.214 | L5V, K19R, N30S, A49G, N54D, D65G, N82bE | 17 | 26 | 3420.0 | 1.3 | 6.6 | 67.42% |
| AC3646 | CD3.215 | L5V, K19R, N30S, A49G, Y52cR, D65G, N82bS | 9 | 18 | 2020.0 | 0.8 | 9.7 | 54.85% |
| AC3647 | CD3.216 | L5V, K19R, N30S, A49G, Y52cT D65G, N82bS | 10 | 19 | 2100.0 | 0.8 | 11.2 | 61.45% |
| AC3648 | CD3.217 | L5V, K19R, N30S, A49G, N54D, D65G, N82bS | 10 | 19 | 1040.0 | 0.4 | 10.7 | 31.11% |
| AC3649 | CD3.218 | L5V, K19R, N30S, A49G, Y58T, D65G, N82bS | 12 | 21 | 800.0 | 0.3 | 52.6 | 3.83% |
| AC3650 | CD3.219 | L5V, K19R, A49G, S52aT, Y52cR, D65G, N82bE | 10 | 17 | 2010.0 | 0.8 | 4.7 | 57.93% |
| AC3651 | CD3.220 | L5V, K19R, N30S, A49G, S52aT, Y52cR, D65G, N82bE | 10 | 17 | 1950.0 | 0.7 | 4.8 | 63.19% |
| AC3652 | CD3.221 | L5V, K19R, | 15 | 22 | 2600.0 | 1.0 | 11.7 | 5.17% |

TABLE 19-continued

| | | | | | | | | |
|---|---|---|---|---|---|---|---|---|
| Pool 2 CD3.23 Mutation Combination Variants | | | | | | | | |
| | | A49G, S52aT, Y52cT D65G, N82bE | | | | | | |
| AC3653 | CD3.222 | L5V, K19R, N30S, A49G, S52aT, Y52cT D65G, N82bE | 15 | 22 | 2440.0 | 0.9 | 10.8 | 33.59% |
| AC3654 | CD3.223 | L5V, K19R, A49G, S52aT, N54D, D65G, N82bE | 17 | 24 | 2890.0 | 1.1 | 6.0 | 68.99% |
| AC3655 | CD3.224 | L5V, K19R, N30S, A49G, S52aT, N54D, D65G, N82bE | 17 | 24 | 2530.0 | 1.0 | 6.4 | 52.55% |
| AC3656 | CD3.225 | L5V, K19R, A49G, S52aT, Y58T, D65G, N82bE | 19 | 26 | 3110.0 | 1.0 | 19.5 | 37.24% |
| AC3657 | CD3.226 | L5V, K19R, N30S, A49G, S52aT, Y58T, D65G, N82bE | 19 | 26 | 1320.0 | 0.4 | 50.9 | 8.94% |
| AC3658 | CD3.227 | L5V, K19R, A49G, S52aT, Y52cR, D65G, N82bS | 3 | 10 | 2850.0 | 1.0 | 8.2 | 62.96% |
| AC3659 | CD3.228 | L5V, K19R, N30S, A49G, S52aT, Y52cR, D65G, N82bS | 3 | 10 | 2750.0 | 0.9 | 6.2 | 80.86% |
| AC3660 | CD3.229 | L5V, K19R, A49G, S52aT, Y52cT, D65G, N82bS | 8 | 15 | 3310.0 | 1.1 | 11.9 | 51.28% |
| AC3661 | CD3.230 | L5V, K19R, N30S, A49G, | 8 | 15 | 2740.0 | 0.9 | 17.0 | 62.00% |

TABLE 19-continued

Pool 2 CD3.23 Mutation Combination Variants

|  |  | S52aT,<br>Y52cT,<br>D65G,<br>N82bS |  |  |  |  |  |  |
|---|---|---|---|---|---|---|---|---|
| AC3662 | CD3.231 | L5V,<br>K19R,<br>A49G,<br>S52aT,<br>N54D,<br>D65G,<br>N82bS | 10 | 17 | 3590.0 | 1.2 | 5.1 | 54.69% |
| AC3663 | CD3.232 | L5V,<br>K19R,<br>N30S,<br>A49G,<br>S52aT,<br>N54D,<br>D65G,<br>N82bS | 10 | 17 | 3890.0 | 1.3 | 5.1 | 74.10% |
| AC3664 | CD3.233 | L5V,<br>K19R,<br>A49G,<br>S52aT,<br>Y58T,<br>D65G,<br>N82bS | 12 | 19 | 3310.0 | 1.1 | 24.9 | 15.01% |
| AC3665 | CD3.234 | L5V,<br>K19R,<br>N30S,<br>A49G,<br>S52aT,<br>Y58T<br>D65G,<br>N82bS | 12 | 19 | 3310.0 | 1.1 | 17.4 | 13.49% |
| AC3666 | CD3.235 | L5V,<br>K19R,<br>A49G,<br>N54E,<br>D65G,<br>N82bS | 14 | 23 | 3620.0 | 1.2 | 6.5 | 63.15% |
| AC3667 | CD3.236 | L5V,<br>K19R,<br>A49G,<br>D65G,<br>N82bS | 8 | 17 | 3180.0 | 1.1 | 21.9 | 0.65% |
| AC3668 | CD3.237 | L5V,<br>K19R,<br>A49G,<br>D65G,<br>N82bE | 15 | 24 | 690.0 | 0.3 | 22.2 | 0 |
| AC3669 | CD3.238 | L5V,<br>K19R,<br>S52aT,<br>Y58T,<br>N82bS | 16 | 23 | 1680.0 | 0.7 | 23.1 | −5.55% |
| AC3670 | CD3.239 | L5V,<br>K19R,<br>Y52cR,<br>Y58T,<br>N82bS | 14 | 21 | 1590.0 | 0.7 | 29.9 | −12.81% |
| AC3671 | CD3.240 | L5V,<br>K19R,<br>Y52cK,<br>Y58T<br>N82bS | 16 | 23 | 1790.0 | 0.7 | 16.5 | −25.28% |
| AC3672 | CD3.241 | L5V<br>K19R, | 14 | 21 | 2280.0 | 0.9 | 92.6 | −183.07% |

TABLE 19-continued

Pool 2 CD3.23 Mutation Combination Variants

| | | Y52cT, Y58T, N82bS | | | | | | |
|---|---|---|---|---|---|---|---|---|
| AC3673 | CD3.242 | L5V, K19R, A49G, N54D, D65G, V78L, N82bS | 9 | 18 | 2620.0 | 1.1 | 7.7 | 34.70% |
| AC3674 | CD3.243 | L5V, K19R, A49G, N54E, D65G, V78L, N82bS | 13 | 22 | ND | ND | ND | ND |
| AC3675 | CD3.244 | L5V, K19R, A49G, D65G, V78L, N82bS | 7 | 16 | 740.0 | 0.3 | 43.6 | −43.16% |
| AC3676 | CD3.245 | L5V, K19R, A49G, D65G, V78L, N82bE | 17 | 26 | 2490.0 | 1.0 | 19.3 | −65.26% |
| AC3677 | CD3.246 | L5V, K19R, S52aT, Y58T, V78L, N82bS | 15 | 22 | 1970.0 | 0.8 | 35.2 | −0.10% |
| AC3678 | CD3.247 | L5V, K19R, Y52cR, Y58T, V78L, N82bS | 13 | 20 | 1880.0 | 0.8 | 28.9 | −59.35% |
| AC3679 | CD3.248 | L5V, K19R, Y52cK, Y58T, V78L, N82bS | 15 | 22 | 1700.0 | 0.7 | 49.2 | −25.51% |
| AC3680 | CD3.249 | L5V, K19R, Y52cT, Y58T. V78L, N82bS | 13 | 20 | 3180.0 | 1.0 | 128.0 | −193.59% |
| AC3681 | CD3.250 | L5V, K19R, A49G, S52aT, Y58T, N82bS | 12 | 19 | 2950.0 | 0.9 | 31.0 | 5.62% |
| AC3682 | CD3.251 | L5V, K19R, A49G, Y52cR, Y58T, N82bS | 8 | 17 | 2730.0 | 0.9 | 32.8 | 11.12% |
| AC3683 | CD3.252 | L5V, K19R, | 9 | 19 | 2280.0 | 0.7 | 22.9 | −13.59% |

TABLE 19-continued

| | | Pool 2 CD3.23 Mutation Combination Variants | | | | | | |
|---|---|---|---|---|---|---|---|---|
| | | A49G, Y52cK, Y58T, N82bS | | | | | | |
| AC3684 | CD3.253 | L5V, K19R, A49G, Y52cT, Y58T, N82bS | 10 | 19 | 2900.0 | 0.9 | 79.9 | −105.16% |
| AC3685 | CD3.254 | L5V, K19R, A49G, S52aT, Y58T, N82bE | 19 | 26 | 2650.0 | 0.8 | 32.3 | 24.18% |
| AC3686 | CD3.255 | L5V, K19R, A49G, Y52cR, Y58T, N82bE | 15 | 24 | 2110.0 | 0.7 | 22.4 | 32.74% |
| AC3687 | CD3.256 | L5V, K19R, A49G Y52cK, Y58T, N82bE | 16 | 26 | ND | ND | ND | ND |
| AC3688 | CD3.257 | L5V, K19R, A49G, Y52cT, Y58T, N82bE | 17 | 26 | 2970.0 | 0.9 | 159.0 | −92.57% |
| AC3689 | CD3.258 | L5V, K19R, A49G, S52aT, Y58T, V78L, N82bS | 11 | 18 | 2840.0 | 0.9 | 38.0 | 22.13% |
| AC3690 | CD3.259 | L5V, K19R, A49G, Y52cR, Y58T, V78L, N82bS | 7 | 16 | 2540.0 | 0.8 | 29.4 | 14.38% |
| AC3691 | CD3.260 | L5V, K19R, A49G, Y52cK, Y58T, V78L, N82bS | 8 | 18 | 2730.0 | 0.9 | 45.6 | 27.07% |
| AC3692 | CD3.261 | L5V, K19R, A49G, Y52cT, Y58T, V78L, N82bS | 9 | 18 | 2200.0 | 0.9 | 97.0 | −122.00% |
| AC3693 | CD3.262 | L5V, K19R, A49G, Y52cR, Y58T, V78L, N82bE | 17 | 26 | 2100.0 | 0.9 | 25.4 | −4.58% |

TABLE 19-continued

Pool 2 CD3.23 Mutation Combination Variants

| AC | | Mutations | | | | | | |
|---|---|---|---|---|---|---|---|---|
| AC3694 | CD3.263 | L5V, A49G, S52aT, Y52cR, D65G, N82bS | 17 | 26 | 2050.0 | 0.8 | 7.2 | 53.06% |
| AC3695 | CD3.264 | L5V, N30S, A49G, S52aT, Y52cR, D65G, N82bS | 17 | 26 | 2500.0 | 1.0 | 4.5 | 55.56% |
| AC3471 | CD3.23 | WT | 50 | 73 | 2738.0 | 1.0 | 13.5 | 63.73% |
| AC3432* | CD3.103 | A49G, Y52cG, D65G, N82bS | 8 | 33 | 3843.3 | 1.3 | 13.5 | 21.44% |
| AC2717* | CD3.23 | WT | 50 | 73 | 3723.3 | 1.3 | 12.9 | 73.42% |

*AC3432 and AC2717 paired with anti-PSMA VHH variant.

**These values are arbitrary reads from the Octet data. A higher number means more protein is presented.

***These values are ratios compared to expression level of CD3.23. Higher ration means higher expression level compared to expression of CD3.23.

TABLE 20

Pool 3 CD3 scFv Variants

| AC | VL sequence | SEQ ID NO: | VH sequence | SEQ ID NO: |
|---|---|---|---|---|
| AC3796 | ELVVTQEPSLTVSPGGTVTLTCRSSN GAVTSSNYANWVQQKPGQAPRGLI GGTNKRAPGTPARFSGSLLGGKAAL TLSGVQPEDEAVYYCALWYPNLWV FGGGTKLTVL | 832 | EVQLVESGGGIVQPGGSLRLS CAASGFTFSTYAMNWVRQAP GKGLEWVGRIRTKRNNYATY YADSVKGRFTISRDDSKNTV YLQMNSLKTEDTAVYYCVR HENFGNSYVSWFAHWGQGT LVTVSS | 755 |
| AC3797 | ELVVTQEPSLTVSPGGTVTLTCRSSN GAVTSSNYANWVQQKPGQAPRGLI GGTNKRAPGTPARFSGSALGGKAA LTLSGVQPEDEAVYYCALWYPNLW VFGGGTKLTVL | 8250 | EVQLVESGGGIVQPGGSLRLS CAASGFTFSTYAMNWVRQAP GKGLEWVGRIRTKRNNYATY YADSVKGRFTISRDDSKNTV YLQMNSLKTEDTAVYYCVR HENFGNSYVSWFAHWGQGT LVTVSS | 755 |
| AC3798 | ELVVTQEPSLTVSPGGTVTLTCRSSN GAVTSSNYANWVQQKPGQAPRGLI GGTNKRAPGTPARFSGSGLGGKAA LTLSGVQPEDEAVYYCALWYPNLW VFGGGTKLTVL | 8251 | EVQLVESGGGIVQPGGSLRLS CAASGFTFSTYAMNWVRQAP GKGLEWVGRIRTKRNNYATY YADSVKGRFTISRDDSKNTV YLQMNSLKTEDTAVYYCVR HENFGNSYVSWFAHWGQGT LVTVSS | 755 |
| AC3799 | ELVVTQEPSLTVSPGGTVTLTCRSSN GAVTSSNYANWVQQKPGQAPRGLI GGTNKRAPGTPARFSGSLNGGKAA LTLSGVQPEDEAVYYCALWYPNLW VFGGGTKLTVL | 8252 | EVQLVESGGGIVQPGGSLRLS CAASGFTFSTYAMNWVRQAP GKGLEWVGRIRTKRNNYATY YADSVKGRFTISRDDSKNTV YLQMNSLKTEDTAVYYCVR HENFGNSYVSWFAHWGQGT LVTVSS | 755 |
| AC3800 | ELVVTQEPSLTVSPGGTVTLTCRSSN GAVTSSNYANWVQQKPGQAPRGLI GGTNKRAPGTPARFSGSLEGGKAAL | 8253 | EVQLVESGGGIVQPGGSLRLS CAASGFTFSTYAMNWVRQAP GKGLEWVGRIRTKRNNYATY | 755 |

TABLE 20-continued

| | | | | |
|---|---|---|---|---|
| | | | Pool 3 CD3 scFv Variants | |
| | TLSGVQPEDEAVYYCALWYPNLWV<br>FGGGTKLTVL | | YADSVKGRFTISRDDSKNTV<br>YLQMNSLKTEDTAVYYCVR<br>HENFGNSYVSWFAHWGQGT<br>LVTVSS | |
| AC3801 | ELVVTQEPSLTVSPGGTVTLTCRSSN<br>GAVTSSNYANWVQQKPGQAPRGLI<br>GGTNKRAPGTPARFSGSLGGGKAA<br>LTLSGVQPEDEAVYYCALWYPNLW<br>VFGGGTKLTVL | 8254 | EVQLVESGGGIVQPGGSLRLS<br>CAASGFTFSTYAMNWVRQAP<br>GKGLEWVGRIRTKRNNYATY<br>YADSVKGRFTISRDDSKNTV<br>YLQMNSLKTEDTAVYYCVR<br>HENFGNSYVSWFAHWGQGT<br>LVTVSS | 755 |
| AC3802 | ELVVTQEPSLTVSPGGTVTLTCRSSN<br>GAVTSSNYANWVQQKPGQAPRGLI<br>GGTNKRAPGTPARFSGSLDGGKAA<br>LTLSGVQPEDEAVYYCALWYPNLW<br>VFGGGTKLTVL | 974 | EVQLVESGGGIVQPGGSLRLS<br>CAASGFTFSTYAMNWVRQAP<br>GKGLEWVGRIRTKRNNYATY<br>YADSVKGRFTISRDDSKNTV<br>YLQMNSLKTEDTAVYYCVR<br>HENFGNSYVSWFAHWGQGT<br>LVTVSS | 755 |
| AC3803 | ELVVTQEPSLTVSPGGTVTLTCRSSN<br>GAVTSSNYANWVQQKPGQAPRGLI<br>GGTNKRAPGTPARFSGSLLGGKAGL<br>TLSGVQPEDEAVYYCALWYPNLWV<br>FGGGTKLTVL | 8255 | EVQLVESGGGIVQPGGSLRLS<br>CAASGFTFSTYAMNWVRQAP<br>GKGLEWVGRIRTKRNNYATY<br>YADSVKGRFTISRDDSKNTV<br>YLQMNSLKTEDTAVYYCVR<br>HENFGNSYVSWFAHWGQGT<br>LVTVSS | 755 |
| AC3804 | ELVVTQEPSLTVSPGGTVTLTCRSSN<br>GAVTSSNYANWVQQKPGQAPRGLI<br>GGTNKRAPGTPARFSGSLLEGKAAL<br>TLSGVQPEDEAVYYCALWYPNLWV<br>FGGGTKLTVL | 127 | EVQLVESGGGIVQPGGSLRLS<br>CAASGFTFSTYAMNWVRQAP<br>GKGLEWVGRIRTKRNNYATY<br>YADSVKGRFTISRDDSKNTV<br>YLQMNSLKTEDTAVYYCVR<br>HENFGNSYVSWFAHWGQGT<br>LVTVSS | 755 |
| AC3805 | ELVVTQEPSLTVSPGGTVTLTCRSSN<br>GAVTSSNYANWVQQKPGQAPRGLI<br>GGTNKRAPGTPARFSGSLLGGKAAL<br>TLSGVQPEDEAVYYCALWYPNLWV<br>FGGGTKLTVL | 832 | EVQLVESGGGIVQPGGSLRLS<br>CAASGFTFSTYAMNWVRQAP<br>GKGLEWVGRIRTKRNDYATY<br>YADSVKGRFTISRDDSKNTA<br>YLQMNSLKTEDTAVYYCVR<br>HENFGNSYVSWFAHWGQGT<br>LVTVSS | 8256 |
| AC3806 | ELVVTQEPSLTVSPGGTVTLTCRSSN<br>GAVTSSNYANWVQQKPGQAPRGLI<br>GGTNKRAPGTPARFSGSALGGKAA<br>LTLSGVQPEDEAVYYCALWYPNLW<br>VFGGGTKLTVL | 8250 | EVQLVESGGGIVQPGGSLRLS<br>CAASGFTFSTYAMNWVRQAP<br>GKGLEWVGRIRTKRNDYATY<br>YADSVKGRFTISRDDSKNTA<br>YLQMNSLKTEDTAVYYCVR<br>HENFGNSYVSWFAHWGQGT<br>LVTVSS | 8256 |
| AC3807 | ELVVTQEPSLTVSPGGTVTLTCRSSN<br>GAVTSSNYANWVQQKPGQAPRGLI<br>GGTNKRAPGTPARFSGSGLGGKAA<br>LTLSGVQPEDEAVYYCALWYPNLW<br>VFGGGTKLTVL | 8251 | EVQLVESGGGIVQPGGSLRLS<br>CAASGFTFSTYAMNWVRQAP<br>GKGLEWVGRIRTKRNDYATY<br>YADSVKGRFTISRDDSKNTA<br>YLQMNSLKTEDTAVYYCVR<br>HENFGNSYVSWFAHWGQGT<br>LVTVSS | 8256 |
| AC3808 | ELVVTQEPSLTVSPGGTVTLTCRSSN<br>GAVTSSNYANWVQQKPGQAPRGLI<br>GGTNKRAPGTPARFSGSLNGGKAA<br>LTLSGVQPEDEAVYYCALWYPNLW<br>VFGGGTKLTVL | 8252 | EVQLVESGGGIVQPGGSLRLS<br>CAASGFTFSTYAMNWVRQAP<br>GKGLEWVGRIRTKRNDYATY<br>YADSVKGRFTISRDDSKNTA<br>YLQMNSLKTEDTAVYYCVR<br>HENFGNSYVSWFAHWGQGT<br>LVTVSS | 8256 |
| AC3809 | ELVVTQEPSLTVSPGGTVTLTCRSSN<br>GAVTSSNYANWVQQKPGQAPRGLI<br>GGTNKRAPGTPARFSGSLEGGKAAL<br>TLSGVQPEDEAVYYCALWYPNLWV<br>FGGGTKLTVL | 8253 | EVQLVESGGGIVQPGGSLRLS<br>CAASGFTFSTYAMNWVRQAP<br>GKGLEWVGRIRTKRNDYATY<br>YADSVKGRFTISRDDSKNTA<br>YLQMNSLKTEDTAVYYCVR<br>HENFGNSYVSWFAHWGQGT<br>LVTVSS | 8256 |

TABLE 20-continued

Pool 3 CD3 scFv Variants

| AC3810 | ELVVTQEPSLTVSPGGTVTLTCRSSN GAVTSSNYANWVQQKPGQAPRGLI GGTNKRAPGTPARFSGSLGGGKAA LTLSGVQPEDEAVYYCALWYPNLW VFGGGTKLTVL | 8254 | EVQLVESGGGIVQPGGSLRLS CAASGFTFSTYAMNWVRQAP GKGLEWVGRIRTKRNDYATY YADSVKGRFTISRDDSKNTA YLQMNSLKTEDTAVYYCVR HENFGNSYVSWFAHWGQGT LVTVSS | 8256 |
|---|---|---|---|---|
| AC3811 | ELVVTQEPSLTVSPGGTVTLTCRSSN GAVTSSNYANWVQQKPGQAPRGLI GGTNKRAPGTPARFSGSLDGGKAA LTLSGVQPEDEAVYYCALWYPNLW VFGGGTKLTVL | 974 | EVQLVESGGGIVQPGGSLRLS CAASGFTFSTYAMNWVRQAP GKGLEWVGRIRTKRNDYATY YADSVKGRFTISRDDSKNTA YLQMNSLKTEDTAVYYCVR HENFGNSYVSWFAHWGQGT LVTVSS | 8256 |
| AC3812 | ELVVTQEPSLTVSPGGTVTLTCRSSN GAVTSSNYANWVQQKPGQAPRGLI GGTNKRAPGTPARFSGSLLGGKAGL TLSGVQPEDEAVYYCALWYPNLWV FGGGTKLTVL | 8255 | EVQLVESGGGIVQPGGSLRLS CAASGFTFSTYAMNWVRQAP GKGLEWVGRIRTKRNDYATY YADSVKGRFTISRDDSKNTA YLQMNSLKTEDTAVYYCVR HENFGNSYVSWFAHWGQGT LVTVSS | 8256 |
| AC3813 | ELVVTQEPSLTVSPGGTVTLTCRSSN GAVTSSNYANWVQQKPGQAPRGLI GGTNKRAPGTPARFSGSLLEGKAAL TLSGVQPEDEAVYYCALWYPNLWV FGGGTKLTVL | 127 | EVQLVESGGGIVQPGGSLRLS CAASGFTFSTYAMNWVRQAP GKGLEWVGRIRTKRNDYATY YADSVKGRFTISRDDSKNTA YLQMNSLKTEDTAVYYCVR HENFGNSYVSWFAHWGQGT LVTVSS | 8256 |
| AC3814 | ELVVTQEPSLTVSPGGTVTLTCRSSN GAVTSSNYANWVQQKPGQAPRGLI GGTNKRAPGTPARFSGSLLGGKAAL TLSGVQPEDEAVYYCALWYPNLWV FGGGTKLTVL | 832 | EVQLVESGGGIVQPGGSLRLS CAASGFTFSTYAMNWVRQAP GKGLEWVGRIRTKRNDYATY YADSVKGRFTISRDDSKNTLY LQMNSLKTEDTAVYYCVRHE NFGNSYVSWFAHWGQGTLV TVSS | 126 |
| AC3815 | ELVVTQEPSLTVSPGGTVTLTCRSSN GAVTSSNYANWVQQKPGQAPRGLI GGTNKRAPGTPARFSGSALGGKAA LTLSGVQPEDEAVYYCALWYPNLW VFGGGTKLTVL | 8250 | EVQLVESGGGIVQPGGSLRLS CAASGFTFSTYAMNWVRQAP GKGLEWVGRIRTKRNDYATY YADSVKGRFTISRDDSKNTLY LQMNSLKTEDTAVYYCVRHE NFGNSYVSWFAHWGQGTLV TVSS | 126 |
| AC3816 | ELVVTQEPSLTVSPGGTVTLTCRSSN GAVTSSNYANWVQQKPGQAPRGLI GGTNKRAPGTPARFSGSGLGGKAA LTLSGVQPEDEAVYYCALWYPNLW VFGGGTKLTVL | 8251 | EVQLVESGGGIVQPGGSLRLS CAASGFTFSTYAMNWVRQAP GKGLEWVGRIRTKRNDYATY YADSVKGRFTISRDDSKNTLY LQMNSLKTEDTAVYYCVRHE NFGNSYVSWFAHWGQGTLV TVSS | 126 |
| AC3817 | ELVVTQEPSLTVSPGGTVTLTCRSSN GAVTSSNYANWVQQKPGQAPRGLI GGTNKRAPGTPARFSGSLNGGKAA LTLSGVQPEDEAVYYCALWYPNLW VFGGGTKLTVL | 8252 | EVQLVESGGGIVQPGGSLRLS CAASGFTFSTYAMNWVRQAP GKGLEWVGRIRTKRNDYATY YADSVKGRFTISRDDSKNTLY LQMNSLKTEDTAVYYCVRHE NFGNSYVSWFAHWGQGTLV TVSS | 126 |
| AC3818 | ELVVTQEPSLTVSPGGTVTLTCRSSN GAVTSSNYANWVQQKPGQAPRGLI GGTNKRAPGTPARFSGSLEGGKAAL TLSGVQPEDEAVYYCALWYPNLWV FGGGTKLTVL | 8253 | EVQLVESGGGIVQPGGSLRLS CAASGFTFSTYAMNWVRQAP GKGLEWVGRIRTKRNDYATY YADSVKGRFTISRDDSKNTLY LQMNSLKTEDTAVYYCVRHE NFGNSYVSWFAHWGQGTLV TVSS | 126 |
| AC3819 | ELVVTQEPSLTVSPGGTVTLTCRSSN GAVTSSNYANWVQQKPGQAPRGLI GGTNKRAPGTPARFSGSLGGGKAA LTLSGVQPEDEAVYYCALWYPNLW VFGGGTKLTVL | 8254 | EVQLVESGGGIVQPGGSLRLS CAASGFTFSTYAMNWVRQAP GKGLEWVGRIRTKRNDYATY YADSVKGRFTISRDDSKNTLY LQMNSLKTEDTAVYYCVRHE | 1261 |

TABLE 20-continued

| | | | | |
|---|---|---|---|---|
| | Pool 3 CD3 scFv Variants | | | |
| | NFGNSYVSWFAHWGQGTLV TVSS | | | |
| AC3820 | ELVVTQEPSLTVSPGGTVTLTCRSSN GAVTSSNYANWVQQKPGQAPRGLI GGTNKRAPGTPARFSGSLDGGKAA LTLSGVQPEDEAVYYCALWYPNLW VFGGGTKLTVL | 974 | EVQLVESGGGIVQPGGSLRLS CAASGFTFSTYAMNWVRQAP GKGLEWVGRIRTKRNDYATY YADSVKGRFTISRDDSKNTLY LQMNSLKTEDTAVYYCVRHE NFGNSYVSWFAHWGQGTLV TVSS | 26 |
| AC3821 | ELVVTQEPSLTVSPGGTVTLTCRSSN GAVTSSNYANWVQQKPGQAPRGLI GGTNKRAPGTPARFSGSLLGGKAGL TLSGVQPEDEAVYYCALWYPNLWV FGGGTKLTVL | 8255 | EVQLVESGGGIVQPGGSLRLS CAASGFTFSTYAMNWVRQAP GKGLEWVGRIRTKRNDYATY YADSVKGRFTISRDDSKNTLY LQMNSLKTEDTAVYYCVRHE NFGNSYVSWFAHWGQGTLV TVSS | 126 |
| AC3822 | ELVVTQEPSLTVSPGGTVTLTCRSSN GAVTSSNYANWVQQKPGQAPRGLI GGTNKRAPGTPARFSGSLLEGKAAL TLSGVQPEDEAVYYCALWYPNLWV FGGGTKLTVL | 127 | EVQLVESGGGIVQPGGSLRLS CAASGFTFSTYAMNWVRQAP GKGLEWVGRIRTKRNDYATY YADSVKGRFTISRDDSKNTLY LQMNSLKTEDTAVYYCVRHE NFGNSYVSWFAHWGQGTLV TVSS | 126 |
| AC3823 | ELVVTQEPSLTVSPGGTVTLTCRSSN GAVTSSNYANWVQQKPGQAPRGLI GGTNKRAPGTPARFSGSLLGGKAAL TLSGVQPEDEAVYYCALWYPNLWV FGGGTKLTVL | 832 | EVQLVESGGGIVQPGGSLRLS CAASGFTFNTYAMNWVRQA PGKGLEWVGRIRTKTNNYAT YYADSVKGRFTISRDDSKNT VYLQMNSLKTEDTAVYYCV RHENFGNSYVSWFAHWGQG TLVTVSS | 757 |
| AC3824 | ELVVTQEPSLTVSPGGTVTLTCRSSN GAVTSSNYANWVQQKPGQAPRGLI GGTNKRAPGTPARFSGSALGGKAA LTLSGVQPEDEAVYYCALWYPNLW VFGGGTKLTVL | 8250 | EVQLVESGGGIVQPGGSLRL SCAASGFTFNTYAMNWVRQA PGKGLEWVGRIRTKTNNYAT YYADSVKGRFTISRDDSKNT VYLQMNSLKTEDTAVYYCV RHENFGNSYVSWFAHWGQG TLVTVSS | 757 |
| AC3825 | ELVVTQEPSLTVSPGGTVTLTCRSSN GAVTSSNYANWVQQKPGQAPRGLI GGTNKRAPGTPARFSGSGLGGKAA LTLSGVQPEDEAVYYCALWYPNLW VFGGGTKLTVL | 8251 | EVQLVESGGGIVQPGGSLRLS CAASGFTFNTYAMNWVRQA PGKGLEWVGRIRTKTNNYAT YYADSVKGRFTISRDDSKNT VYLQMNSLKTEDTAVYYCV RHENFGNSYVSWFAHWGQG TLVTVSS | 757 |
| AC3826 | ELVVTQEPSLTVSPGGTVTLTCRSSN GAVTSSNYANWVQQKPGQAPRGLI GGTNKRAPGTPARFSGSLNGGKAA LTLSGVQPEDEAVYYCALWYPNLW VFGGGTKLTVL | 8252 | EVQLVESGGGIVQPGGSLRLS CAASGFTFNTYAMNWVRQA PGKGLEWVGRIRTKTNNYAT YYADSVKGRFTISRDDSKNT VYLQMNSLKTEDTAVYYCV RHENFGNSYVSWFAHWGQG TLVTVSS | 757 |
| AC3827 | ELVVTQEPSLTVSPGGTVTLTCRSSN GAVTSSNYANWVQQKPGQAPRGLI GGTNKRAPGTPARFSGSLEGGKAAL TLSGVQPEDEAVYYCALWYPNLWV FGGGTKLTVL | 8253 | EVQLVESGGGIVQPGGSLRLS CAASGFTFNTYAMNWVRQA PGKGLEWVGRIRTKTNNYAT YYADSVKGRFTISRDDSKNT VYLQMNSLKTEDTAVYYCV RHENFGNSYVSWFAHWGQG TLVTVSS | 757 |
| AC3828 | ELVVTQEPSLTVSPGGTVTLTCRSSN GAVTSSNYANWVQQKPGQAPRGLI GGTNKRAPGTPARFSGSLGGGKAA LTLSGVQPEDEAVYYCALWYPNLW VFGGGTKLTVL | 8254 | EVQLVESGGGIVQPGGSLRLS CAASGFTFNTYAMNWVRQA PGKGLEWVGRIRTKTNNYAT YYADSVKGRFTISRDDSKNT VYLQMNSLKTEDTAVYYCV RHENFGNSYVSWFAHWGQG TLVTVSS | 757 |
| AC3829 | ELVVTQEPSLTVSPGGTVTLTCRSSN GAVTSSNYANWVQQKPGQAPRGLI GGTNKRAPGTPARFSGSLDGGKAA | 974 | EVQLVESGGGIVQPGGSLRLS CAASGFTFNTYAMNWVRQA PGKGLEWVGRIRTKTNNYAT | 757 |

TABLE 20-continued

| | | | | |
|---|---|---|---|---|
| | Pool 3 CD3 scFv Variants | | | |

| | LTLSGVQPEDEAVYYCALWYPNLW VFGGGTKLTVL | | | YYADSVKGRFTISRDDSKNT VYLQMNSLKTEDTAVYYCV RHENFGNSYVSWFAHWGQG TLVTVSS |
|---|---|---|---|---|
| AC3830 | ELVVTQEPSLTVSPGGTVTLTCRSSN GAVTSSNYANWVQQKPGQAPRGLI GGTNKRAPGTPARFSGSLLGGKAGL TLSGVQPEDEAVYYCALWYPNLWV FGGGTKLTVL | 8255 | EVQLVESGGGIVQPGGSLRL SCAASGFTFNTYAMNWVRQA PGKGLEWVGRIRTKTNNYAT YYADSVKGRFTISRDDSKNT VYLQMNSLKTEDTAVYYCV RHENFGNSYVSWFAHWGQG TLVTVSS | 757 |
| AC3831 | ELVVTQEPSLTVSPGGTVTLTCRSSN GAVTSSNYANWVQQKPGQAPRGLI GGTNKRAPGTPARFSGSLLEGKAAL TLSGVQPEDEAVYYCALWYPNLWV FGGGTKLTVL | 127 | EVQLVESGGGIVQPGGSLRLS CAASGFTFNTYAMNWVRQA PGKGLEWVGRIRTKTNNYAT YYADSVKGRFTISRDDSKNT VYLQMNSLKTEDTAVYYCV RHENFGNSYVSWFAHWGQG TLVTVSS | 757 |
| AC3832 | ELVVTQEPSLTVSPGGTVTLTCRSSN GAVTSSNYANWVQQKPGQAPRGLI GGTNKRAPGTPARFSGSLLGGKAAL TLSGVQPEDEAVYYCALWYPNLWV FGGGTKLTVL | 832 | EVQLVESGGGIVQPGGSLRLS CAASGFTFNTYAMNWVRQA PGKGLEWVGRIRTKTNDYAT YYADSVKGRFTISRDDSKNT AYLQMNSLKTEDTAVYYCV RHENFGNSYVSWFAHWGQG TLVTVSS | 8257 |
| AC3833 | ELVVTQEPSLTVSPGGTVTLTCRSSN GAVTSSNYANWVQQKPGQAPRGLI GGTNKRAPGTPARFSGSALGGKAA LTLSGVQPEDEAVYYCALWYPNLW VFGGGTKLTVL | 8250 | EVQLVESGGGIVQPGGSLRLS CAASGFTFNTYAMNWVRQA PGKGLEWVGRIRTKTNDYAT YYADSVKGRFTISRDDSKNT AYLQMNSLKTEDTAVYYCV RHENFGNSYVSWFAHWGQG TLVTVSS | 8257 |
| AC3834 | ELVVTQEPSLTVSPGGTVTLTCRSSN GAVTSSNYANWVQQKPGQAPRGLI GGTNKRAPGTPARFSGSGLGGKAA LTLSGVQPEDEAVYYCALWYPNLW VFGGGTKLTVL | 8251 | EVQLVESGGGIVQPGGSLRLS CAASGFTFNTYAMNWVRQA PGKGLEWVGRIRTKTNDYAT YYADSVKGRFTISRDDSKNT AYLQMNSLKTEDTAVYYCV RHENFGNSYVSWFAHWGQG TLVTVSS | 8257 |
| AC3835 | ELVVTQEPSLTVSPGGTVTLTCRSSN GAVTSSNYANWVQQKPGQAPRGLI GGTNKRAPGTPARFSGSLNGGKAA LTLSGVQPEDEAVYYCALWYPNLW VFGGGTKLTVL | 8252 | EVQLVESGGGIVQPGGSLRLS CAASGFTFNTYAMNWVRQA PGKGLEWVGRIRTKTNDYAT YYADSVKGRFTISRDDSKNT AYLQMNSLKTEDTAVYYCV RHENFGNSYVSWFAHWGQG TLVTVSS | 8257 |
| AC3836 | ELVVTQEPSLTVSPGGTVTLTCRSSN GAVTSSNYANWVQQKPGQAPRGLI GGTNKRAPGTPARFSGSLEGGKAAL TLSGVQPEDEAVYYCALWYPNLWV FGGGTKLTVL | 8253 | EVQLVESGGGIVQPGGSLRLS CAASGFTFNTYAMNWVRQA PGKGLEWVGRIRTKTNDYAT YYADSVKGRFTISRDDSKNT AYLQMNSLKTEDTAVYYCV RHENFGNSYVSWFAHWGQG TLVTVSS | 8257 |
| AC3837 | ELVVTQEPSLTVSPGGTVTLTCRSSN GAVTSSNYANWVQQKPGQAPRGLI GGTNKRAPGTPARFSGSLGGGKAA LTLSGVQPEDEAVYYCALWYPNLW VFGGGTKLTVL | 8254 | EVQLVESGGGIVQPGGSLRLS CAASGFTFNTYAMNWVRQA PGKGLEWVGRIRTKTNDYAT YYADSVKGRFTISRDDSKNT AYLQMNSLKTEDTAVYYCV RHENFGNSYVSWFAHWGQG TLVTVSS | 8257 |
| AC3838 | ELVVTQEPSLTVSPGGTVTLTCRSSN GAVTSSNYANWVQQKPGQAPRGLI GGTNKRAPGTPARFSGSLDGGKAA LTLSGVQPEDEAVYYCALWYPNLW VFGGGTKLTVL | 974 | EVQLVESGGGIVQPGGSLRLS CAASGFTFNTYAMNWVRQA PGKGLEWVGRIRTKTNDYAT YYADSVKGRFTISRDDSKNT AYLQMNSLKTEDTAVYYCV RHENFGNSYVSWFAHWGQG TLVTVSS | 8257 |

TABLE 20-continued

Pool 3 CD3 scFv Variants

| | | | | |
|---|---|---|---|---|
| AC3839 | ELVVTQEPSLTVSPGGTVTLTCRSSN GAVTSSNYANWVQQKPGQAPRGLI GGTNKRAPGTPARFSGSLLGGKAGL TLSGVQPEDEAVYYCALWYPNLWV FGGGTKLTVL | 8255 | EVQLVESGGGIVQPGGSLRLS CAASGFTFNTYAMNWVRQA PGKGLEWVGRIRTKTNDYAT YYADSVKGRFTISRDDSKNT AYLQMNSLKTEDTAVYYCV RHENFGNSYVSWFAHWGQG TLVTVSS | 8257 |
| AC3840 | ELVVTQEPSLTVSPGGTVTLTCRSSN GAVTSSNYANWVQQKPGQAPRGLI GGTNKRAPGTPARFSGSLLEGKAAL TLSGVQPEDEAVYYCALWYPNLWV FGGGTKLTVL | 127 | EVQLVESGGGIVQPGGSLRLS CAASGFTFNTYAMNWVRQA PGKGLEWVGRIRTKTNDYAT YYADSVKGRFTISRDDSKNT AYLQMNSLKTEDTAVYYCV RHENFGNSYVSWFAHWGQG TLVTVSS | 8257 |
| AC3841 | ELVVTQEPSLTVSPGGTVTLTCRSSN GAVTSSNYANWVQQKPGQAPRGLI GGTNKRAPGTPARFSGSLLGGKAAL TLSGVQPEDEAVYYCALWYPNLWV FGGGTKLTVL | 832 | EVQLVESGGGIVQPGGSLRLS CAASGFTFNTYAMNWVRQA PGKGLEWVGRIRTKTNDYAT YYADSVKGRFTISRDDSKNTL YLQMNSLKTEDTAVYYCVR HENFGNSYVSWFAHWGQGT LVTVSS | 8258 |
| AC3842 | ELVVTQEPSLTVSPGGTVTLTCRSSN GAVTSSNYANWVQQKPGQAPRGLI GGTNKRAPGTPARFSGSALGGKAA LTLSGVQPEDEAVYYCALWYPNLW VFGGGTKLTVL | 8250 | EVQLVESGGGIVQPGGSLRLS CAASGFTFNTYAMNWVRQA PGKGLEWVGRIRTKTNDYAT YYADSVKGRFTISRDDSKNTL YLQMNSLKTEDTAVYYCVR HENFGNSYVSWFAHWGQGT LVTVSS | 8258 |
| AC3843 | ELVVTQEPSLTVSPGGTVTLTCRSSN GAVTSSNYANWVQQKPGQAPRGLI GGTNKRAPGTPARFSGSGLGGKAA LTLSGVQPEDEAVYYCALWYPNLW VFGGGTKLTVL | 8251 | EVQLVESGGGIVQPGGSLRLS CAASGFTFNTYAMNWVRQA PGKGLEWVGRIRTKTNDYAT YYADSVKGRFTISRDDSKNTL YLQMNSLKTEDTAVYYCVR HENFGNSYVSWFAHWGQGT LVTVSS | 8258 |
| AC3844 | ELVVTQEPSLTVSPGGTVTLTCRSSN GAVTSSNYANWVQQKPGQAPRGLI GGTNKRAPGTPARFSGSLNGGKAA LTLSGVQPEDEAVYYCALWYPNLW VFGGGTKLTVL | 8252 | EVQLVESGGGIVQPGGSLRLS CAASGFTFNTYAMNWVRQA PGKGLEWVGRIRTKTNDYAT YYADSVKGRFTISRDDSKNTL YLQMNSLKTEDTAVYYCVR HENFGNSYVSWFAHWGQGT LVTVSS | 8258 |
| AC3845 | ELVVTQEPSLTVSPGGTVTLTCRSSN GAVTSSNYANWVQQKPGQAPRGLI GGTNKRAPGTPARFSGSLEGGKAAL TLSGVQPEDEAVYYCALWYPNLWV FGGGTKLTVL | 8253 | EVQLVESGGGIVQPGGSLRLS CAASGFTFNTYAMNWVRQA PGKGLEWVGRIRTKTNDYAT YYADSVKGRFTISRDDSKNTL YLQMNSLKTEDTAVYYCVR HENFGNSYVSWFAHWGQGT LVTVSS | 8258 |
| AC3846 | ELVVTQEPSLTVSPGGTVTLTCRSSN GAVTSSNYANWVQQKPGQAPRGLI GGTNKRAPGTPARFSGSLGGGKAA LTLSGVQPEDEAVYYCALWYPNLW VFGGGTKLTVL | 8254 | EVQLVESGGGIVQPGGSLRLS CAASGFTFNTYAMNWVRQA PGKGLEWVGRIRTKTNDYAT YYADSVKGRFTISRDDSKNTL YLQMNSLKTEDTAVYYCVR HENFGNSYVSWFAHWGQGT LVTVSS | 8258 |
| AC3847 | ELVVTQEPSLTVSPGGTVTLTCRSSN GAVTSSNYANWVQQKPGQAPRGLI GGTNKRAPGTPARFSGSLDGGKAA LTLSGVQPEDEAVYYCALWYPNLW VFGGGTKLTVL | 974 | EVQLVESGGGIVQPGGSLRLS CAASGFTFNTYAMNWVRQA PGKGLEWVGRIRTKTNDYAT YYADSVKGRFTISRDDSKNTL YLQMNSLKTEDTAVYYCVR HENFGNSYVSWFAHWGQGT LVTVSS | 8258 |
| AC3848 | ELVVTQEPSLTVSPGGTVTLTCRSSN GAVTSSNYANWVQQKPGQAPRGLI GGTNKRAPGTPARFSGSLLGGKAGL TLSGVQPEDEAVYYCALWYPNLWV FGGGTKLTVL | 8255 | EVQLVESGGGIVQPGGSLRLS CAASGFTFNTYAMNWVRQA PGKGLEWVGRIRTKTNDYAT YYADSVKGRFTISRDDSKNTL YLQMNSLKTEDTAVYYCVR | 8258 |

TABLE 20-continued

Pool 3 CD3 scFv Variants

|  |  |  |  |  |
|---|---|---|---|---|
|  |  |  | HENFGNSYVSWFAHWGQGT LVTVSS |  |
| AC3849 | ELVVTQEPSLTVSPGGTVTLTCRSSN GAVTSSNYANWVQQKPGQAPRGLI GGTNKRAPGTPARFSGSLLEGKAAL TLSGVQPEDEAVYYCALWYPNLWV FGGGTKLTVL | 127 | EVQLVESGGGIVQPGGSLRLS CAASGFTFNTYAMNWVRQA PGKGLEWVGRIRTKTNDYAT YYADSVKGRFTISRDDSKNTL YLQMNSLKTEDTAVYYCVR HENFGNSYVSWFAHWGQGT LVTVSS | 8258 |
| AC3850 | ELVVTQEPSLTVSPGGTVTLTCRSSN GAVTSSNYANWVQQKPGQAPRGLI GGTNKRAPGTPARFSGSLLGGKAAL TLSGVQPEDEAVYYCALWYPNLWV FGGGTKLTVL | 832 | EVQLVESGGGIVQPGGSLRLS CAASGFTFSTYAMNWVRQAP GKGLEWVGRIRTKTNNYATY YADSVKGRFTISRDDSKNTV YLQMNSLKTEDTAVYYCVR HENFGNSYVSWFAHWGQGT LVTVSS | 759 |
| AC3857 | ELVVTQEPSLTVSPGGTVTLTCRSSN GAVTSSNYANWVQQKPGQAPRGLI GGTNKRAPGTPARFSGSLLGGKAGL TLSGVQPEDEAVYYCALWYPNLWV FGGGTKLTVL | 8255 | EVQLVESGGGIVQPGGSLRLS CAASGFTFSTYAMNWVRQAP GKGLEWVGRIRTKTNNYATY YADSVKGRFTISRDDSKNTV YLQMNSLKTEDTAVYYCVR HENFGNSYVSWFAHWGQGT LVTVSS | 759 |
| AC3860 | ELVVTQEPSLTVSPGGTVTLTCRSSN GAVTSSNYANWVQQKPGQAPRGLI GGTNKRAPGTPARFSGSALGGKAA LTLSGVQPEDEAVYYCALWYPNLW VFGGGTKLTVL | 8250 | EVQLVESGGGIVQPGGSLRLS CAASGFTFSTYAMNWVRQAP GKGLEWVGRIRTKTNDYATY YADSVKGRFTISRDDSKNTA YLQMNSLKTEDTAVYYCVR HENFGNSYVSWFAHWGQGT LVTVSS | 8259 |
| AC3867 | ELVVTQEPSLTVSPGGTVTLTCRSSN GAVTSSNYANWVQQKPGQAPRGLI GGTNKRAPGTPARFSGSLLEGKAAL TLSGVQPEDEAVYYCALWYPNLWV FGGGTKLTVL | 127 | EVQLVESGGGIVQPGGSLRLS CAASGFTFSTYAMNWVRQAP GKGLEWVGRIRTKTNdYATY YADSVKGRFTISRDDSKNTaY LQMNSLKTEDTAVYYCVRHE NFGNSYVSWFAHWGQGTLV TVSS | 8259 |
| AC3869 | ELVVTQEPSLTVSPGGTVTLTCRSSN GAVTSSNYANWVQQKPGQAPRGLI GGTNKRAPGTPARFSGSALGGKAA LTLSGVQPEDEAVYYCALWYPNLW VFGGGTKLTVL | 8250 | EVQLVESGGGIVQPGGSLRLS CAASGFTFSTYAMNWVRQAP GKGLEWVGRIRTKTNDYATY YADSVKGRFTISRDDSKNTLY LQMNSLKTEDTAVYYCVRHE NFGNSYVSWFAHWGQGTLV TVSS | 8260 |
| AC3877 | ELVVTQEPSLTVSPGGTVTLTCRSSN GAVTSSNYANWVQQKPGQAPRGLI GGTNKRAPGTPARFSGSLLGGKAAL TLSGVQPEDEAVYYCALWYPNLWV FGGGTKLTVL | 832 | EVQLVESGGGIVQPGGSLRLS CAASGFTFSTYAMNWVRQAP GKGLEDVGRIRTKRNNYATY YADSVKGRFTISRDDSKNTV YLQMNSLKTEDTAVYYCVR HENFGNSYVSWFAHWGQGT LVTVSS | 8261 |
| AC3878 | ELVVTQEPSLTVSPGGTVTLTCRSSN GAVTSSNYANWVQQKPGQAPRGLI GGTNKRAPGTPARFSGSLLGGKAAL TLSGVQPEDEAVYYCALWYPNLWV FGGGTKLTVL | 832 | EVQLVESGGGIVQPGGSLRLS CAASGFTFSTYAMNWVRQAP GKGLEWGGRIRTKRNNYATY YADSVKGRFTISRDDSKNTV YLQMNSLKTEDTAVYYCVR HENFGNSYVSWFAHWGQGT LVTVSS | 8262 |
| AC3879 | ELVVTQEPSLTVSPGGTVTLTCRSSN GAVTSSNYANWVQQKPGQAPRGLI GGTNKRAPGTPARFSGSLLGGKAAL TLSGVQPEDEAVYYCALWYPNLWV FGGGTKLTVL | 832 | EVQLVESGGGIVQPGGSLRLS CAASGFTFSTYAMNWVRQAP GKGLEWVGRIRTPRNNYATY YADSVKGRFTISRDDSKNTV YLQMNSLKTEDTAVYYCVR HENFGNSYVSWFAHWGQGT LVTVSS | 8263 |
| AC3880 | ELVVTQEPSLTVSPGGTVTLTCRSSN GAVTSSNYANWVQQKPGQAPRGLI GGTNKRAPGTPARFSGSLLGGKAAL | 832 | EVQLVESGGGIVQPGGSLRLS CAASGFTFSTYAMNWVRQAP GKGLEWVGRIRTKPNNYATY | 8264 |

TABLE 20-continued

| | | | | Pool 3 CD3 scFv Variants | |
|---|---|---|---|---|---|
| | TLSGVQPEDEAVYYCALWYPNLWV<br>FGGGTKLTVL | | | YADSVKGRFTISRDDSKNTV<br>YLQMNSLKTEDTAVYYCVR<br>HENFGNSYVSWFAHWGQGT<br>LVTVSS | |
| AC3881 | ELVVTQEPSLTVSPGGTVTLTCRSSN<br>GAVTSSNYANWVQQKPGQAPRGLI<br>GGTNKRAPGTPARFSGSLLGGKAAL<br>TLSGVQPEDEAVYYCALWYPNLWV<br>FGGGTKLTVL | 832 | | EVQLVESGGGIVQPGGSLRLS<br>CAASGFTFSTYAMNWVRQAP<br>GKGLEWVGRIRTKRNNYATT<br>YADSVKGRFTISRDDSKNTV<br>YLQMNSLKTEDTAVYYCVR<br>HENFGNSYVSWFAHWGQGT<br>LVTVSS | 8265 |
| AC3882 | ELVVTQEPSLTVSPGGTVTLTCRSSN<br>GAVTSSNYANWVQQKPGQAPRGLI<br>GGTNKRAPGTPARFSGSLLGGKAAL<br>TLSGVQPEDEAVYYCALWYPNLWV<br>FGGGTKLTVL | 832 | | EVQLVESGGGIVQPGGSLRLS<br>CAASGFTFSTYAMNWVRQAP<br>GKGLEWVGRIRTKRNNYATY<br>DADSVKGRFTISRDDSKNTV<br>YLQMNSLKTEDTAVYYCVR<br>HENFGNSYVSWFAHWGQGT<br>LVTVSS | 8266 |
| AC3883 | ELVVTQEPSLTVSPGGTVTLTCRSSN<br>GAVTSSNYANWVQQKPGQAPRGLI<br>GGTNKRAPGTPARFSGSLLGGKAAL<br>TLSGVQPEDEAVYYCALWYPNLWV<br>FGGGTKLTVL | 832 | | EVQLVESGGGIVQPGGSLRLS<br>CAASGFTFSTYAMNWVRQAP<br>GKGLEWVGRIRTKRNNYATY<br>WADSVKGRFTISRDDSKNTV<br>YLQMNSLKTEDTAVYYCVR<br>HENFGNSYVSWFAHWGQGT<br>LVTVSS | 8267 |
| AC3884 | ELVVTQEPSLTVSPGGTVTLTCRSSN<br>GAVTSSNYANWVQQKPGQAPRGLI<br>GGTNKRAPGTPARFSGSLLGGKAAL<br>TLSGVQPEDEAVYYCALWYPNLWV<br>FGGGTKLTVL | 832 | | EVQLVESGGGIVQPGGSLRLS<br>CAASGFTFSTYAMNWVRQAP<br>GKGLEWVGRIRTKRNNYTTY<br>YADSVKGRFTISRDDSKNTV<br>YLQMNSLKTEDTAVYYCVR<br>HENFGNSYVSWFAHWGQGT<br>LVTVSS | 8268 |
| AC3885 | ELVVTQEPSLTVSPGGTVTLTCRSSN<br>GAVTSSNYANWVQQKPGQAPRGLI<br>GGTNKRAPGTPARFSGSLLGGKAAL<br>TLSGVQPEDEAVYYCALWYPNLWV<br>FGGGTKLTVL | 832 | | EVQLVESGGGIVQPGGSLRLS<br>CAASGFTFSTYAMNWVRQAP<br>GKGLEWVGRIRTKRNNYATY<br>YADSVKGRFTISRDDSKNTV<br>YLQMNSLKTEDTAVYYCVR<br>HENFGASYVSWFAHWGQGT<br>LVTVSS | 8269 |
| AC3886 | ELVVTQEPSLTVSPGGTVTLTCRSSN<br>GAVTSSNYANWVQQKPGQAPRGLI<br>GGTNKRAPGTPARFSGSLLGGKAAL<br>TLSGVQPEDEAVYYCALWYPNLWV<br>FGGGTKLTVL | 832 | | EVQLVESGGGIVQPGGSLRLS<br>CAASGFTFSTYAMNWVRQAP<br>GKGLEWVGRIRTKRNNYATY<br>YADSVKGRFTISRDDSKNTV<br>YLQMNSLKTEDTAVYYCVR<br>HENFGNAYVSWFAHWGQGT<br>LVTVSS | 8270 |
| AC3768 | ELVVTQEPSLTVSPGGTVTLTCRSSN<br>GAVTSSNYANWVQQKPGQAPRGLI<br>GGTNKRAPGTPARFSGSLLGGKAAL<br>TLSGVQPEDEAVYYCALWYPNLWV<br>FGGGTKLTVL | 832 | | EVQLLESGGGIVQPGGSLKLS<br>CAASGFTFNTYAMNWVRQA<br>PGKGLEWVARIRSKYNNYAT<br>YYADSVKDRFTISRDDSKNT<br>VYLQMNNLKTEDTAVYYCV<br>RHENFGNSYVSWFAHWGQG<br>TLVTVSS | 833 |
| AC2885 | ELVVTQEPSLTVSPGGTVTLTCRSSN<br>GAVTSSNYANWVQQKPGQAPRGLI<br>GGTNKRAPGTPARFSGSLLGGKAAL<br>TLSGVQPEDEAVYYCALWYPNLWV<br>FGGGTKLTVL | 832 | | EVQLLESGGGIVQPGGSLKLS<br>CAASGFTFNTYAMNWVRQA<br>PGKGLEWVARIRSKYNNYAT<br>YYADSVKDRFTISRDDSKNT<br>VYLQMNNLKTEDTAVYYCV<br>RHENFGNSYVSWFAHWGQG<br>TLVTVSS | 833 |
| AC3659 | ELVVTQEPSLTVSPGGTVTLTCRSSN<br>GAVTSSNYANWVQQKPGQAPRGLI<br>GGTNKRAPGTPARFSGSLLGGKAAL<br>TLSGVQPEDEAVYYCALWYPNLWV<br>FGGGTKLTVL | 832 | | EVQLVESGGGIVQPGGSLRLS<br>CAASGFTFSTYAMNWVRQAP<br>GKGLEWVGRIRTKRNNYATY<br>YADSVKGRFTISRDDSKNTV<br>YLQMNSLKTEDTAVYYCVR<br>HENFGNSYVSWFAHWGQGT<br>LVTVSS | 755 |

TABLE 20-continued

| | | | | | Binding | % | Binding, |
| | | | | | KD | Remaining | KD |
| | CD3.23 | PTE | Binding, | % Remaining | (nM) | Stability | (nM) |
| AC# | domain | score v22 | K_D (nM) | Stability* | R2 | R2** | R3 |
|-----|--------|-----------|----------|-------------|------|-----------|-----|

Pool 3 CD3 scFv Variants

| AC3660 | ELVVTQEPSLTVSPGGTVTLTCRSSN GAVTSSNYANWVQQKPGQAPRGLI GGTNKRAPGTPARFSGSLLGGKAAL TLSGVQPEDEAVYYCALWYPNLWV FGGGTKLTVL | 832 | EVQLVESGGGIVQPGGSLRLS CAASGFTFNTYAMNWVRQA PGKGLEWVGRIRTKTNNYAT YYADSVKGRFTISRDDSKNT VYLQMNSLKTEDTAVYYCV RHENFGNSYVSWFAHWGQG TLVTVSS | 757 |
|--------|--------|-----|--------|-----|

| AC# | CD3.23 domain | PTE score v22 | Binding, K_D (nM) | % Remaining Stability* | Binding KD (nM) R2 | % Remaining Stability R2** | Binding, KD (nM) R3 |
|-----|--------|-----------|----------|-------------|------|-----------|-----|
| AC3796 | CD3.292 | 10 | 3.89 | ND | 4.1 | 81% | 3.0 |
| AC3797 | CD3.293 | 3 | 3.80 | 61.59% | 3.72 | ND | ND |
| AC3798 | CD3.294 | 3 | 3.05 | 63.93% | 5.75 | ND | ND |
| AC3799 | CD3.295 | 3 | 3.11 | 73.85% | 3.70 | 78.71% | ND |
| AC3800 | CD3.296 | 3 | 4.74 | 72.95% | 17.01 | ND | ND |
| AC3801 | CD3.297 | 3 | 3.92 | 19.10% | 21.18 | 78.71% | ND |
| AC3802 | CD3.298 | 3 | 4.07 | 73.43% | 8.00 | 83.80% | ND |
| AC3803 | CD3.299 | 3 | ND | ND | 7.964 | ND | ND |
| AC3804 | CD3.300 | 7 | 36.56 | ND | ND | ND | ND |
| AC3805 | CD3.301 | 7 | 5.53 | ND | ND | 84% | 4.4 |
| AC3806 | CD3.302 | 0 | 5.09 | 38.94% | ND | 48.59% | ND |
| AC3807 | CD3.303 | 0 | 6.08 | ND | ND | 54.57% | ND |
| AC3808 | CD3.304 | 0 | 4.31 | 51.07% | ND | ND | ND |
| AC3809 | CD3.305 | 0 | 6.28 | ND | ND | 69% | 4.6 |
| AC3810 | CD3.306 | 0 | 5.09 | 54.79% | ND | 67.27% | ND |
| AC3811 | CD3.307 | 0 | 6.35 | ND | ND | 63% | 4.8 |
| AC3812 | CD3.308 | 0 | 5.56 | 35.06% | ND | 58.92% | ND |
| AC3813 | CD3.309 | 4 | 5.82 | 67.83% | ND | 85% | 5.4 |
| AC3814 | CD3.310 | 7 | 4.10 | ND | ND | ND | ND |
| AC3815 | CD3.311 | 0 | 4.53 | 55.16% | ND | ND | ND |
| AC3816 | CD3.312 | 0 | 4.12 | 53.29% | ND | ND | ND |
| AC3817 | CD3.313 | 0 | 3.86 | 34.23% | ND | ND | ND |
| AC3818 | CD3.314 | 0 | 4.02 | 5.76% | ND | ND | ND |
| AC3819 | CD3.315 | 0 | 3.40 | 54.09% | ND | ND | ND |
| AC3820 | CD3.316 | 0 | 3.99 | 50.35% | ND | ND | ND |
| AC3821 | CD3.317 | 0 | 4.10 | 1.15% | ND | ND | ND |
| AC3822 | CD3.318 | 4 | 5.38 | 85.02% | 5.7 | 61.81% | ND |
| AC3823 | CD3.319 | 15 | ND | ND | ND | ND | ND |
| AC3824 | CD3.320 | 8 | 10.94 | ND | ND | ND | ND |
| AC3825 | CD3.321 | 8 | 10.03 | ND | ND | ND | ND |
| AC3826 | CD3.322 | 8 | 7.00 | ND | ND | ND | ND |
| AC3827 | CD3.323 | 8 | ND | ND | ND | ND | ND |

TABLE 20-continued

| | | | Pool 3 CD3 scFv Variants | | | | |
|---|---|---|---|---|---|---|---|
| AC3828 | CD3.324 | 8 | 7.21 | ND | ND | ND | ND |
| AC3829 | CD3.325 | 8 | 10.07 | ND | ND | ND | ND |
| AC3830 | CD3.326 | 8 | 6.65 | ND | ND | ND | ND |
| AC3831 | CD3.327 | 12 | ND | ND | ND | ND | ND |
| AC3832 | CD3.328 | 14 | ND | ND | ND | ND | ND |
| AC3833 | CD3.329 | 7 | ND | ND | ND | ND | ND |
| AC3834 | CD3.330 | 7 | 23.35 | ND | ND | ND | ND |
| AC3835 | CD3.331 | 7 | 35.72 | ND | ND | ND | ND |
| AC3836 | CD3.332 | 7 | 30.57 | ND | ND | ND | ND |
| AC3837 | CD3.333 | 7 | 17.88 | ND | ND | ND | ND |
| AC3838 | CD3.334 | 7 | 30.69 | ND | ND | ND | ND |
| AC3839 | CD3.335 | 7 | 24.48 | ND | ND | ND | ND |
| AC3840 | CD3.336 | 11 | 32.65 | ND | ND | ND | ND |
| AC3841 | CD3.337 | 14 | 12.18 | ND | ND | ND | ND |
| AC3842 | CD3.338 | 7 | 17.02 | ND | ND | ND | ND |
| AC3843 | CD3.339 | 7 | 15.37 | ND | ND | ND | ND |
| AC3844 | CD3.340 | 7 | 10.58 | ND | ND | ND | ND |
| AC3845 | CD3.341 | 7 | 15.75 | ND | ND | ND | ND |
| AC3846 | CD3.342 | 7 | 9.99 | ND | ND | ND | ND |
| AC3847 | CD3.343 | 7 | 14.01 | ND | ND | ND | ND |
| AC3848 | CD3.344 | 7 | 14.17 | ND | ND | ND | ND |
| AC3849 | CD3.345 | 11 | 18.01 | ND | ND | ND | ND |
| AC3850 | CD3.346 | 15 | 9.83 | ND | 10.8 | 75.67% | ND |
| AC3857 | CD3.353 | 8 | 12.27 | ND | ND | ND | ND |
| AC3860 | CD3.356 | 7 | 29.42 | ND | ND | 68% | 19.7 |
| AC3867 | CD3.363 | 11 | 62.74 | ND | ND | | ND |
| AC3869 | CD3.365 | 7 | 18.77 | ND | ND | 52.21% | ND |
| AC3877 | CD3.373 | 10 | 8.92 | ND | ND | 51.39% | ND |
| AC3878 | CD3.374 | 11 | ND | ND | 17.0 | 44.73% | ND |
| AC3879 | CD3.375 | 8 | ND | ND | ND | ND | ND |
| AC3880 | CD3.376 | 8 | 12.95 | ND | ND | 57.88% | ND |
| AC3881 | CD3.377 | 8 | 10.66 | ND | ND | 69% | 10.4 |
| AC3882 | CD3.378 | 8 | 3.74 | 65.49% | ND | ND | ND |
| AC3883 | CD3.379 | 9 | 4.19 | 46.17% | ND | ND | ND |
| AC3884 | CD3.380 | 8 | 4.54 | 71.07% | ND | ND | ND |
| AC3885 | CD3.381 | 10 | ND | ND | ND | 75% | 4.2 |
| AC3886 | CD3.382 | 10 | ND | ND | 21.2 | 70.38% | ND |
| AC3768 | CD3.23 control | 73 | 4.67 | 66% | 8.0 | 64% | 5.6 |

TABLE 20-continued

| | | | Pool 3 CD3 scFv Variants | | | | |
|---|---|---|---|---|---|---|---|
| AC2885 | CD3.23 | 73 | 15.41 | ND | ND | ND | ND |
| AC3659 | CD3.228 | 10 | 5.14 | 68.89% | ND | ND | ND |
| AC3660 | CD3.229 | 15 | 13.61 | ND | ND | ND | ND |

Only antibodies AC2885, AC3659, and AC3660 were paired with an anti-tumor antibody to form a paTCE.
All other CD3 scFv antibodies were unpaired.
*5 min at 60° C. in lysis buffer vs huCD3e-mFc
**5 min at 62° C. in lysis buffer (Triton-free) vs huCD3e-mFc

Example 3. Selection of Anti-EGFR and Anti-CD3 paTCE paTCEs including the improved anti-EGFR binding sequence of EGFR.37 and anti-CD3 binding sequences selected from Example 2 were produced and tested. The anti-CD3 domains tested with EGFR.37 were chosen due to low PTE score and increased thermal stability. Binding to human CD3 was determined by Bio-Layer Interferometry at room temperature with CD3& as the antigen. Stability was determined by Differential Scanning Fluorimetry. In vitro cytotoxicity with unmasked uTCE was determined in an HT-29 cell line with an Effector to Target (E: T) ratio of 5 to 1. Predicted immunogenicity was determined by a proprietary v25 PTE algorithm. The results are shown in Table 21.

TABLE 21

| | | | | Anti-CD3 domains with EGFR.37 | | |
|---|---|---|---|---|---|---|
| Anti-EGFR | Anti-CD3 | Tm (° C.) | $EC_{50}$ HT-29 (pM) | PTE Score v25 CD3 | PTE Score v25 EGFR | Combined PTE Score v25 |
| EGFR.2 | CD3.9 | n.d. | 14 | 100 | 75 | 175 |
| EGFR.37 | CD3.23 | 68.65 | 38 | 112 | 60 | 172 |
| | CD3.228 | 70.63 | n.d. | 44 | 60 | 104 |
| | CD3.295 | 69.84 | n.d. | 52 | 60 | 112 |
| | CD3.318 | 69.79 | 64 | 35 | 60 | 95 | n.d. = no data

EGFR.37 was selected for at least its improved thermostability and expression as compared to EGFR.2 (see Example 1). CD3.318 was selected for at least its decreased PTE score as compared to any of CD3.23, CD3.228, CD3.295. A paTCE having the combination of EGFR.37/CD3.318 exhibited increased stability, decreased predicted immunogenicity, and decreased potency as compared to prior paTCEs.

Importantly, the paTCE including the combination of EGFR.37/CD3.318 demonstrated a lower potency (increase $EC_{50}$ in cytotoxicity assay) as compared to a previously described paTCE including EGFR.2/CD3.9 (referred to above as EGRF-XPAT gen1). This is meaningful as decreased potency relative to EGRF-XPAT gen1 is desirable as it is expected to attenuate cytokine release syndrome (CRS) and T cell activation, resulting in a greater therapeutic safety window. Preliminary studies in cynomolgus monkeys suggest that the maximum tolerated dose for EGFR-XPAT gen1 under the conditions tested was 1 mg/kg at which point symptoms of CRS were observed. By contrast, the maximum tolerated dose under the same conditions for EGFR.37/CD3.318 (in AMX-525) was increased to 4.5 mg/kg and the observed dose-limiting toxicities suggested that they were no longer the result of CRS. This lends further evidence that the loss of potency observed for the EGFR.37/CD3.318 combination may result in a greater therapeutic index.

In view of the above, the combination of EGFR.37/CD3.318 was selected to be incorporated into AMX-525.

Example 4. Design of Barcoded ELNNs by Minimal Mutations in ELNNs

ELNN polypeptide sequences can optionally contain a barcode fragment releasable from the polypeptide upon digestion by a protease. A barcode fragment may be, e.g., (1) a portion of the ELNN that includes at least part of a (non-recurring, non-overlapping) sequence motif that occurs only once within the ELNN; and (2) differs in sequence and molecular weight from all other peptide fragments that are releasable from the polypeptide containing them (e.g., a paTCE) upon complete digestion of the polypeptide by a protease. The term "barcode fragment" ("barcode," or "barcode sequence") can refer to either the portion of the ELNN cleavably fused within the polypeptide, or the resulting peptide fragment released from the polypeptide. Previous barcode sequences (see, e.g., PCT International Patent Publication No. WO2021/263058, the entire content of which is incorporated herein by reference) were designed with the intention of creating unique barcode polypeptide sequences with as minimal mutations in the original ELNN sequence as possible. However, such barcode sequences required 1000 µg/mL of Glu-C and an overnight digest to release them from peptides containing them, such as paTCEs. The barcode polypeptide sequences described in this Example were designed and tested to perform against a second criteria: That the barcode polypeptide is releasable from the ELNN polypeptide rapidly (in approximately two hours vs an overnight digest) by a low concentration of protease (less than 30 µg/mL protease); in addition to the criteria of introducing the fewest mutations to the original ELNN sequence as possible.

In order to determine which peptide sequences were most favorably cleaved by Glu-C protease in a two-hour protease digest, a library of approximately 1000 peptides was constructed with each peptide containing a different cleavage sequence for the protease Glu-C. Equimolar concentrations of these Glu-C site-containing peptides were tested in a 2-hour digest against a range of Glu-C protease concentrations from 0.05 µg/mL to 1000 µg/mL of protease. After digestion the peptides were analyzed by liquid chromatography mass spectrometry. The Glu-C cleavage site sequences that were cleaved by the lowest concentrations of protease were cataloged. From this list of the fastest sequences, a select few were selected that were most compatible with ELNN polypeptides. These sequences were then implemented to flank new "Generation 2" barcode sequences.

A selection of Generation 2 barcode sequences was cloned into ELNN sequences and their performance as barcode peptides was tested by Glu-C digestion and subsequent liquid chromatography mass spectrometry analyses. Successful barcode sequences from this experiment had 3 criteria: 1.) The barcode peptide was fully releasable from the ELNN polypeptide in a 2-hour digest by a concentration of 40 μg/mL of protease. 2.) The barcode peptide was not cleaved or otherwise degraded by much higher concentrations of protease, and 3.) The barcode peptide that met conditions 1 and 2 contained the fewest mutations from the original ELNN polypeptide sequence. Table 22 provides examples of successful Generation 2 barcode sequences according to the criteria of the aforementioned selection process.

TABLE 22

Exemplary Generation 2 Barcode Sequences

| | |
|---|---|
| Gen 2 Barcode 01 | SGPE.SGPGTGTSATPE.SGPG (SEQ ID NO: 8271) |
| Gen 2 Barcode 02 | ATPE.SGPGSGPGTSE.SATP (SEQ ID NO: 8272) |
| Gen 2 Barcode 03 | ATPE.SGPGTTPGTTPE.SGPG (SEQ ID NO: 8273) |
| Gen 2 Barcode 04 | ATPE.SGPGTPPTSTPE.SGPG (SEQ ID NO: 8274) |
| Gen 2 Barcode 05 | ATPE.SGPGTSPSATPE.SGPG (SEQ ID NO: 8275) |
| Gen 2 Barcode 06 | ATPE.SGPGTGSAGTPE.SGPG (SEQ ID NO: 8276) |
| Gen 2 Barcode 07 | ATPE.SGPGTGGAGTPE.SGPG (SEQ ID NO: 8277) |
| Gen 2 Barcode 08 | ATPE.SGPGTSPGATPE.SGPG (SEQ ID NO: 8278) |
| Gen 2 Barcode 09 | GTPE.SGPGTSGSGTPE.SGPG (SEQ ID NO: 8279) |
| Gen 2 Barcode 10 | GTPE.SGPGTSSASTPE.SGPG (SEQ ID NO: 8280) |
| Gen 2 Barcode 11 | GTPE.SGPGTGAGTTPE.SGPG (SEQ ID NO: 8281) |
| Gen 2 Barcode 12 | GTPE.SGPGTGSTSTPE.SGPG (SEQ ID NO: 8282) |
| Gen 2 Barcode 13 | GTPE.TPGSEPATSGSE.TGTP (SEQ ID NO: 8283) |
| Gen 2 Barcode 14 | GTPE.GSAPGTSTEPSE.SATP (SEQ ID NO: 8284) |
| Gen 2 Barcode 15 | ATPE.SGPGTAGSGTPE.SGPG (SEQ ID NO: 8285) |
| Gen 2 Barcode 16 | ATPE.SGPGTSSGGTPE.SGPG (SEQ ID NO: 8286) |
| Gen 2 Barcode 17 | ATPE.SGPGTAGPATPE.SGPG (SEQ ID NO: 8287) |
| Gen 2 Barcode 18 | ATPE.SGPGTPGTGTPE.SGPG (SEQ ID NO: 8288) |
| Gen 2 Barcode 19 | TTPE.SGPGTGGPTTPE.SGPG (SEQ ID NO: 8289) |

TABLE 22-continued

Exemplary Generation 2 Barcode Sequences

| | |
|---|---|
| Gen 2 Barcode 20 | STPE.SGPGTGSGSTPE.SGPG (SEQ ID NO: 8222) |

Example 5. Release Site Engineering

Incubation of a paTCE comprising RSR-2295 in human plasma showed some cleavage that, though not high, was unexpected. Further investigation revealed that the cleavage was surprisingly due to legumain, which has previously believed to be specifically present in tumor tissues. Additionally, it was initially believed that legumain cleavage provided meaningful levels of paTCE activation in tumor tissues.

A new release site was designed to avoid cleavage by legumain, resulting in RSR-3213. Surprisingly, a paTCE containing RSR-3213 release sequences was cleaved less in plasma but at comparable amounts to a corresponding paTCE comprising RSR-2295 release sequences in multiple tumor types (including gastric carcinoma (NCI-N87), colorectal adenocarcinoma (HT-29), colon carcinoma (HT-55) tumors). Thus, paTCEs comprising RSR-3213 have enhanced specificity for tumor tissues without a significant loss of activation in tumor tissues.

Figure 7A:
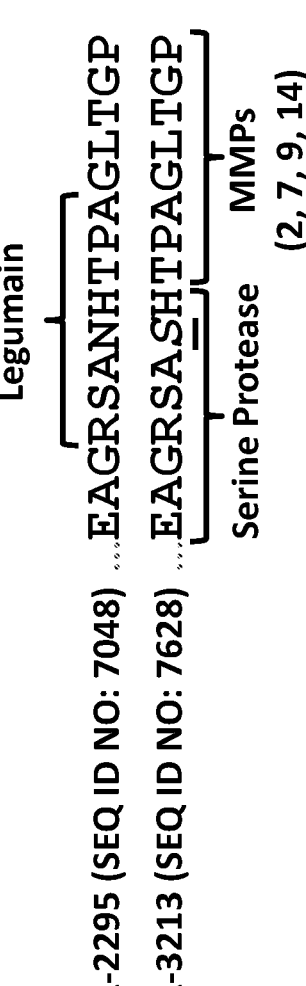
FIG. 7A depicts an alignment of the RSR-2295 and RSR-3213 amino acid sequences and proteases capable of cleaving them.
Figure 7B:
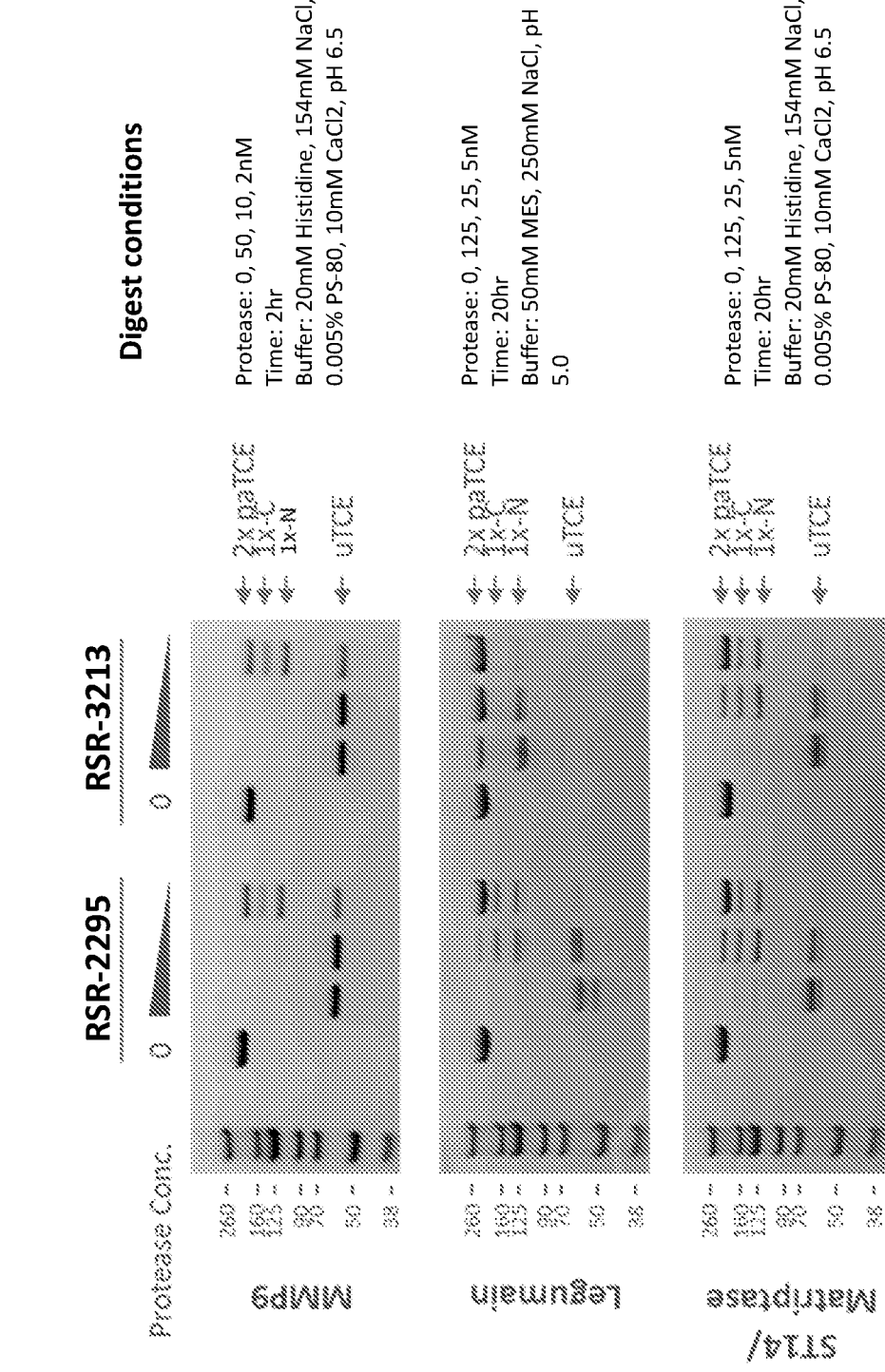
FIG. 7B depicts in vitro protease digestion of paTCEs employing RSR-2295 or RSR-3213. The RSR-3213 sequence is modified to substantially reduce cleavage by legumain.

In Vitro Digest:

In vitro digest assays were performed to demonstrate that RSR-3213 is cleaved by MMP and ST14/matriptase, but not legumain. Two EpCAM-targeting paTCE (EpCAM-paTCE) molecules (one of having RSR-2295 on both sides of the TCE, and the other having RSR-3213 on both sides of the TCE) flanking the TCE core were digested with 5-fold dilutions of MMP9, legumain, or ST14/matriptase. Similar banding patterns were observed for both MMP9 and matriptase, suggesting the mutation of the legumain cleavage site did not affect cleavability of the MMP and serine protease cleavage sites. uTCE was observed for the paTCE containing RSR-2295 after digestion with legumain, indicating cleavage at the protease cleavable linker by legumain. uTCE was not observed for the paTCE containing RSR-3213 after digestion with legumain, indicating the mutation successfully prevented cleavage at the protease cleavable linker by legumain (FIG. 7A and FIG. 7B).

Plasma Stability—In Vivo Cleavability

Figure 8A:
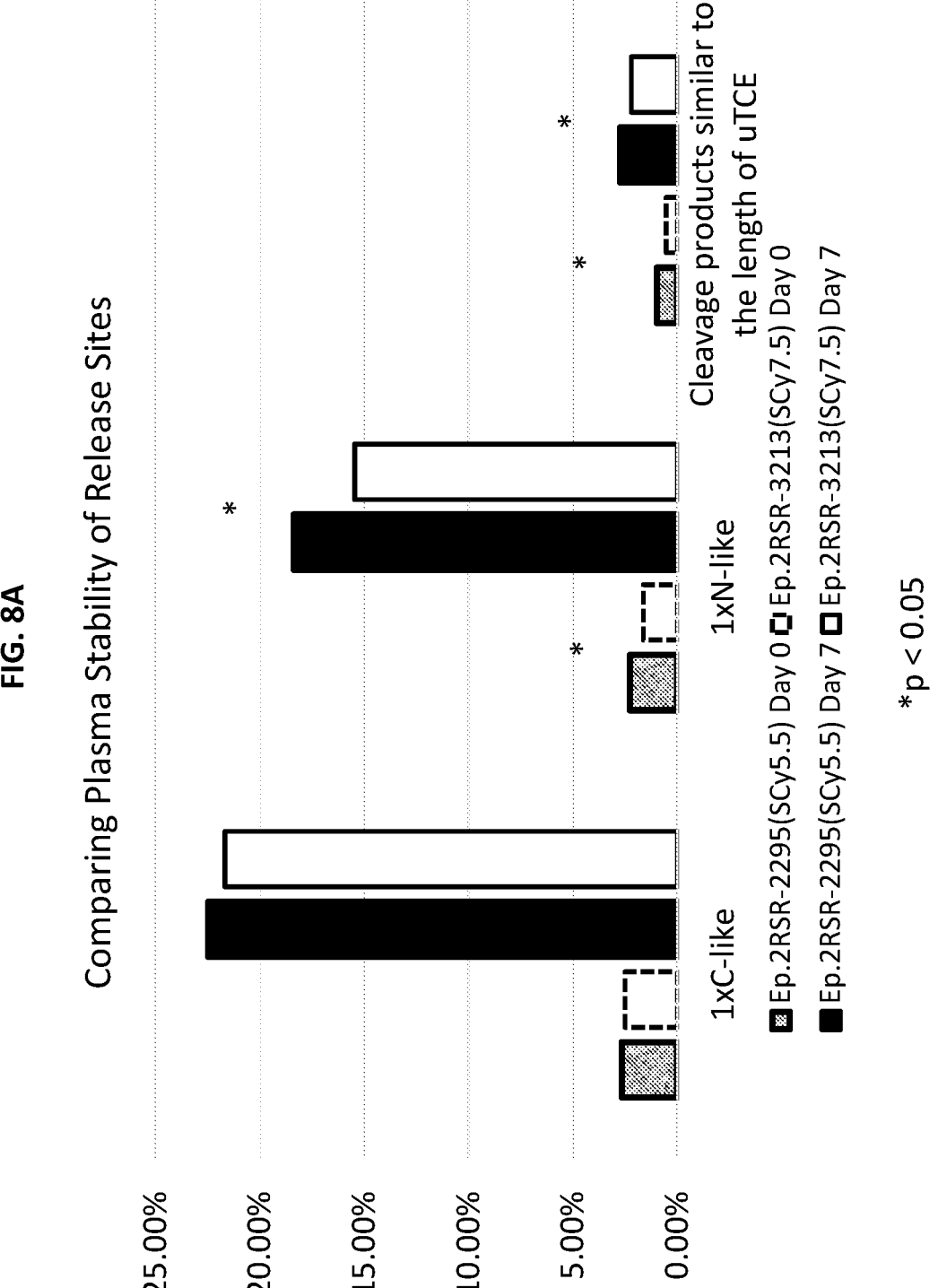
Figure 8B:
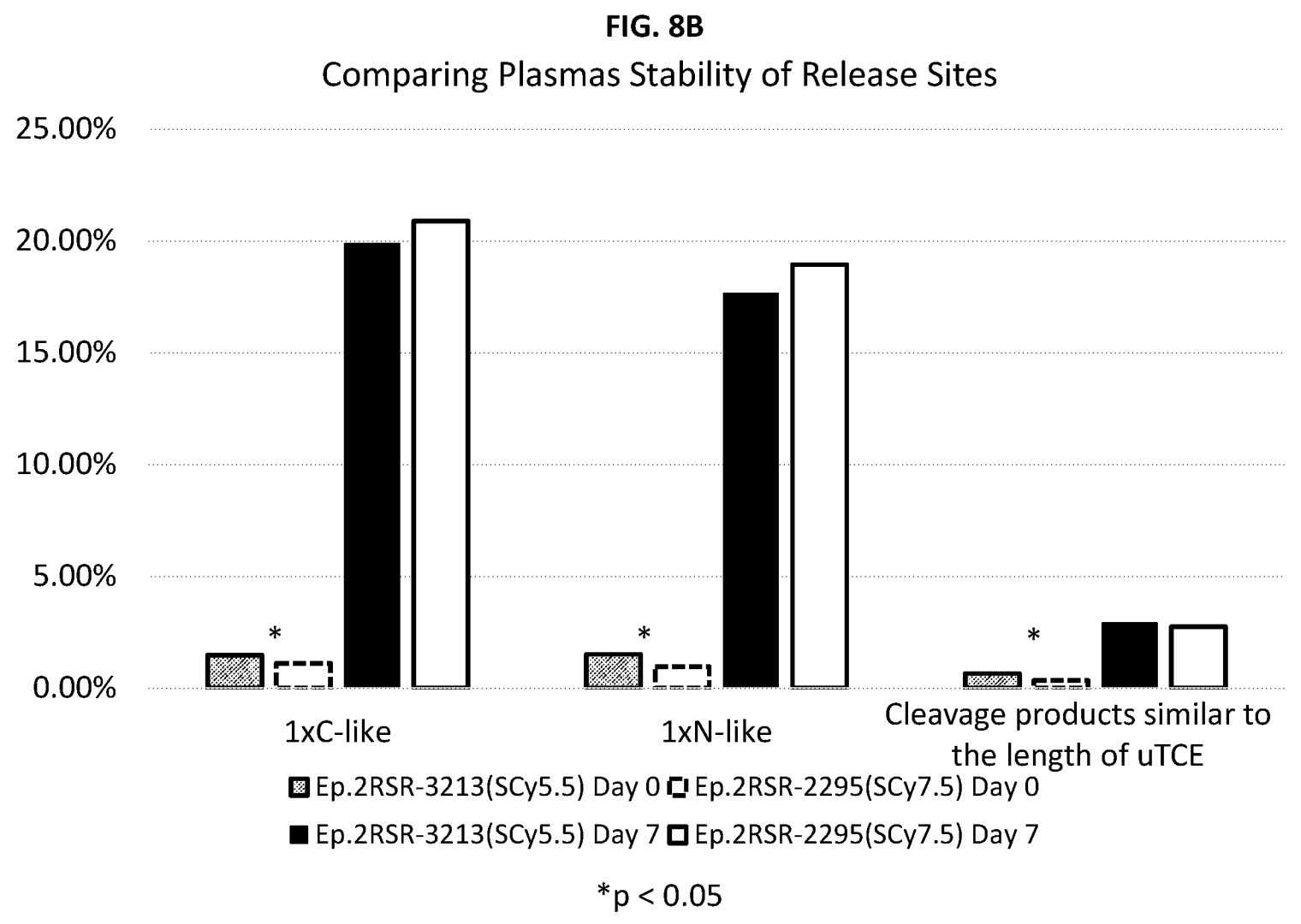

Fluorescently labeled variants of an EpCAM-paTCE containing either RSR-2295 or RSR-3213 were labeled with Sulfo-Cy5.5 or Sulfo-Cy7.5. Opposite colors were co-injected into mice containing NCI-N87, HT-29, or HT-55 xenograft tumors. 48 hours after injection, tumors were harvested, homogenized, and protein extracts were analyzed by SDS-PAGE and LI-COR. Relative abundances for paTCE, 1×-C, 1×-N, and uTCE were quantified. No significant differences were observed in uTCE and 1×-C between the two protease cleavable linkers. paTCE containing RSR-2295 showed a small but statistically significant increase (average 2.19% more) in 1×-N than the corresponding paTCE containing RSR-3213. (FIG. 8A and FIG. 8B).

Figure 8C:
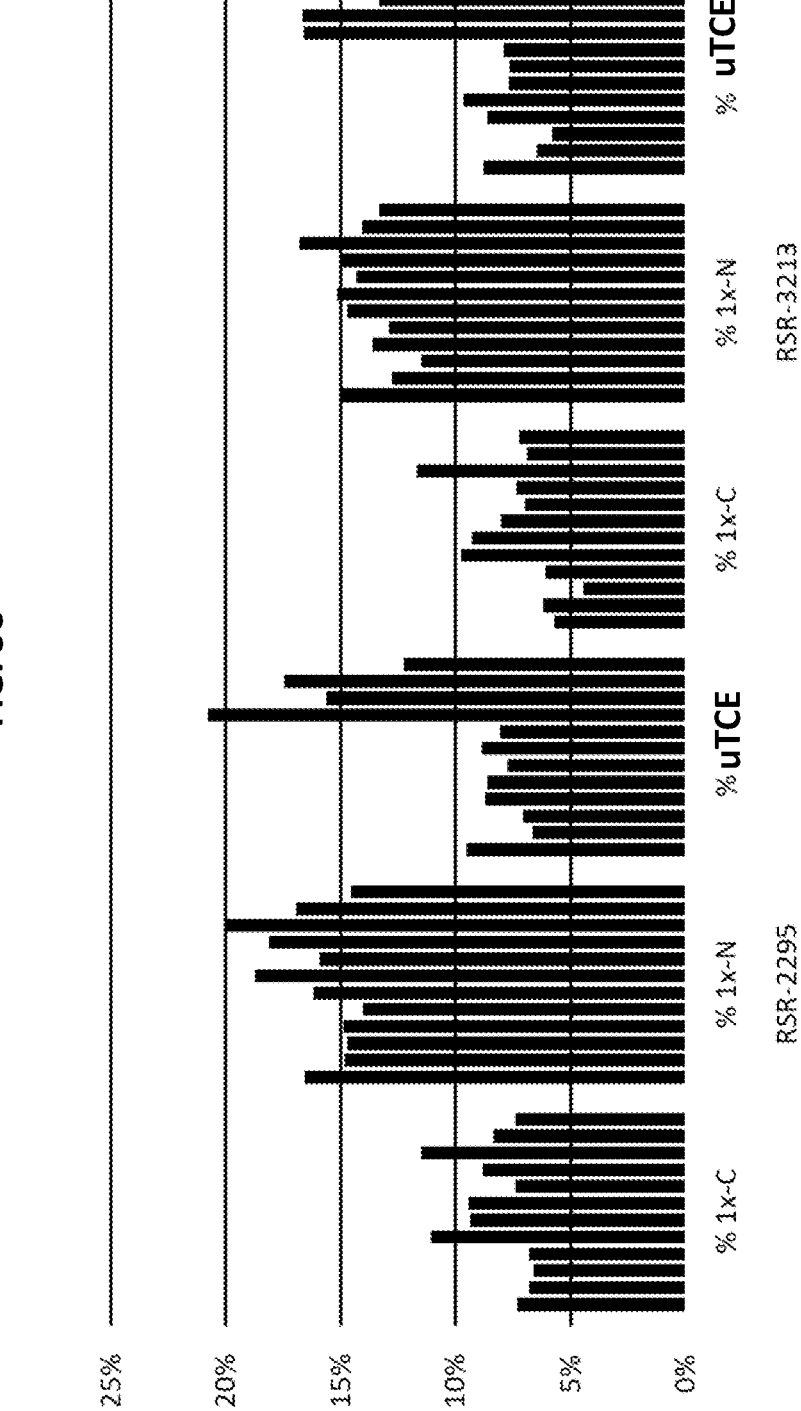
FIG. 8C depicts the observed cleavability in vivo from tumor homogenates from 3 different mouse tumor models. For each set of bar graphs (i.e., % 1x-C, % 1x-N, % uTCE), each bar from left to right represents B1, B2, B3, B4, A1, A2, A3, A4, 43-1, 43-2, 43-3, and 43-4. B1-B4 represent 4 different mice from a first tumor model (NCI-N87). A1-A4 represent 4 different mice from a second tumor model (HT-29). 43-1-43-4 represent 4 different mice from a third tumor model (HT-55).

The observed cleavability in vivo from tumor homogenates was also determined from 3 different mouse tumor models. The % abundance for metabolites 1×-C, 1×-N, and uTCE was measured with results depicted in FIG. 8C.

Figure 8D:
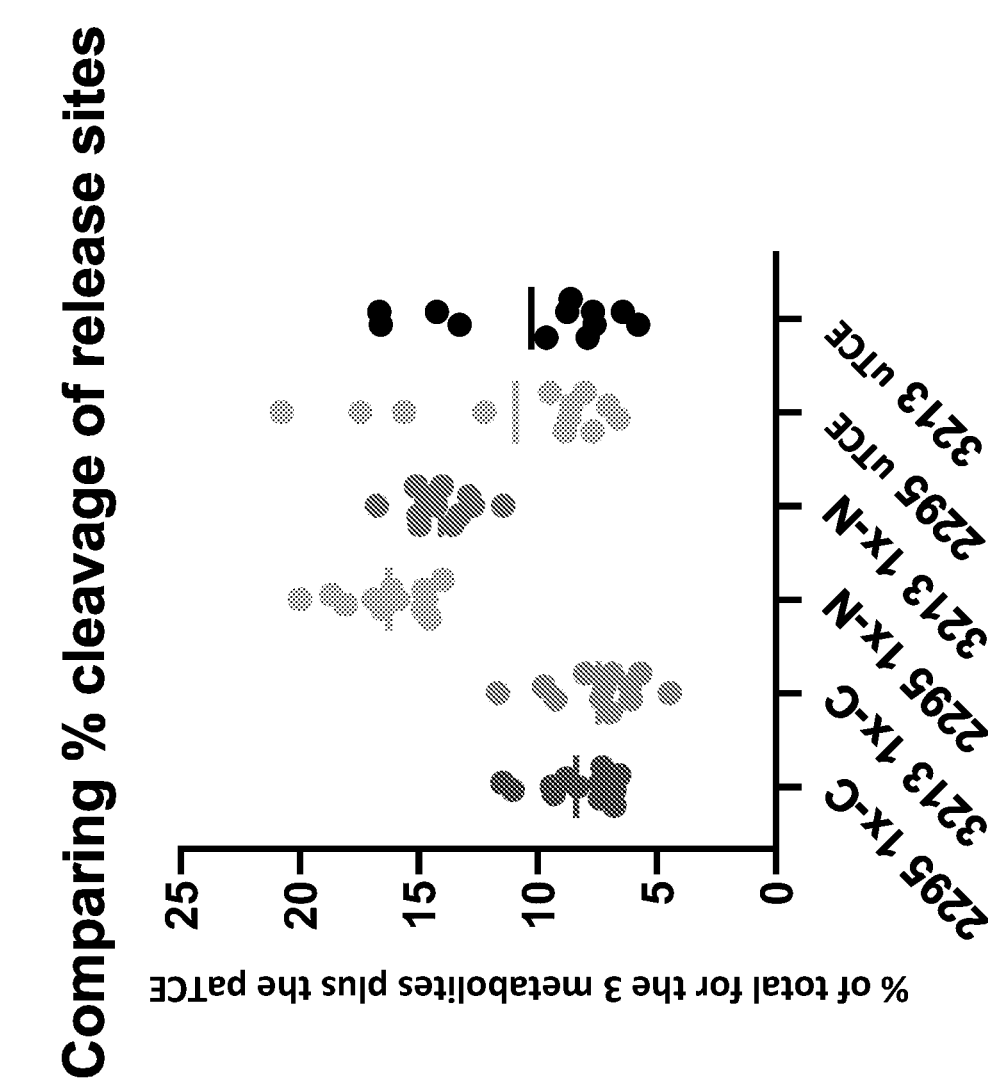
FIG. 8D depicts the % of total for the 3 metabolites plus the paTCE (paTCE, 1x-N, 1x-C, and uTCE) when employing RSR-2295 or RSR-3213.

Finally, FIG. 8D depicts the % of total for paTCE plus the 3 metabolites (1x-N, 1x-C, and uTCE) when employing RSR-2295 or RSR-3213.

Overall, these data suggest that differences between in vivo cleavability of RSR-2295 and RSR-3213 are minor across 3 different tumor models.

Tumor Uptake:

Tumor uptake between EpCAM-paTCEs containing either RSR-2295 or RSR-3213 were compared using the ratio of calculated concentrations of total drug (paTCE, 1x-C, 1x-N, and uTCE).

Figure 9:
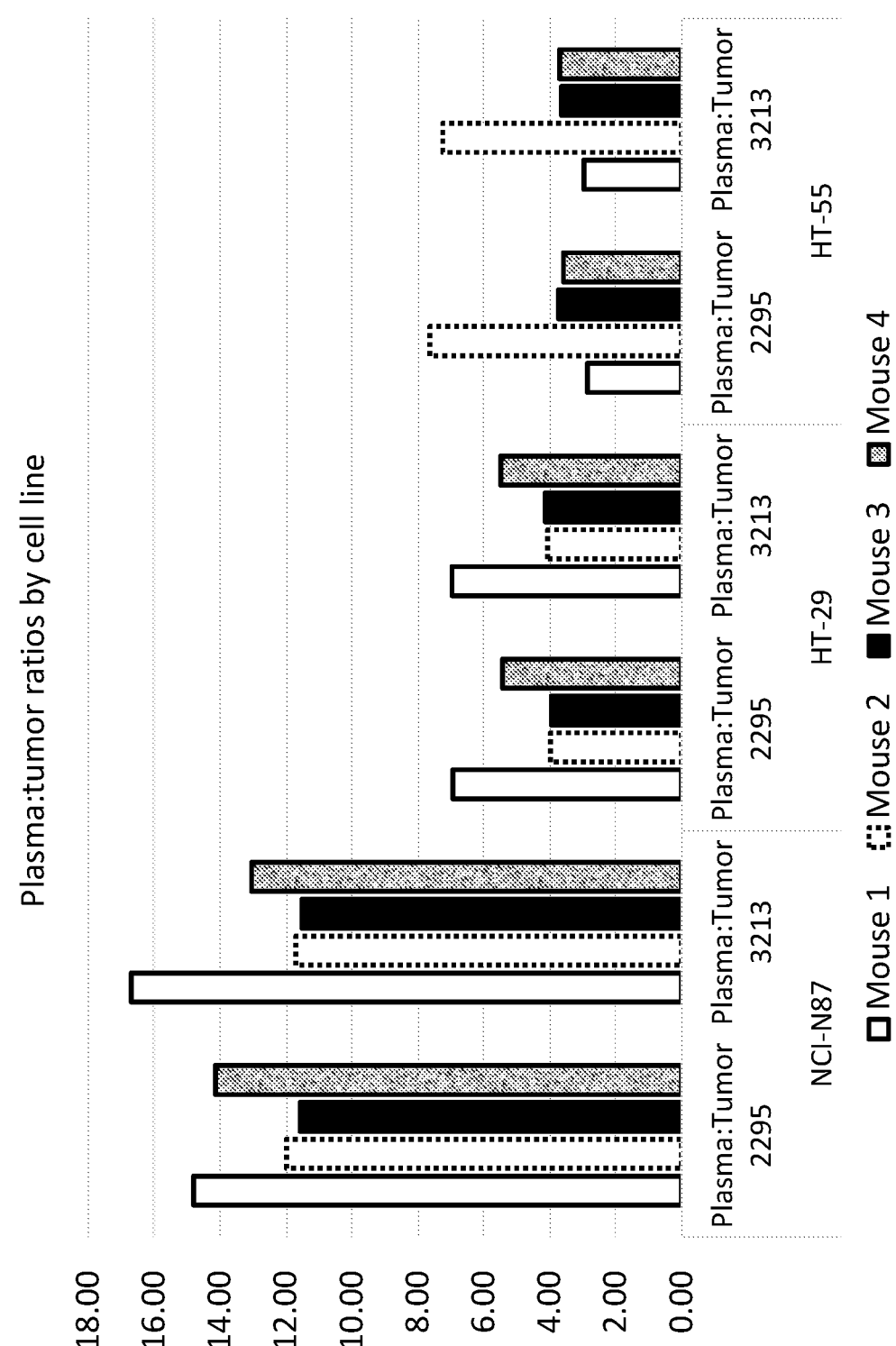
FIG. 9 depicts relative tumor uptake of paTCEs employing RSR-2295 or RSR-3213. The plasma: tumor ratio was calculated in 3 different mouse tumor models (4 mice per tumor model). There is a "Mouse 1" for each of the 3 different tumor models, a "Mouse 2" for each of the 3 different tumor models, a "Mouse 3" for each of the different tumor models, and a "Mouse 4" for each of the 3 different tumor models.

While differences in tumor uptake were observed across 3 different tumor models, no significant differences were observed between RSR-2295 and RSR-3213 within each model. This indicates that the changes to the protease cleavable linkers between RSR-2295 and RSR-3213 do not affect tumor uptake of paTCE (FIG. 9).

Example 6. AMX-525, an Exemplary EGFR-Targeting Protease-Activated TCE

This example provides data relating to an exemplary paTCE, referred to as AMX-525. AMX-525 comprises the amino acid sequence set forth as SEQ ID NO: 1000. The annotated amino acid sequence for AMX-525 is provided below in Table 23:

| Component | SEQ ID NO: | Sequence | Annotation |
|---|---|---|---|
| X294(K) | 8021 | ASSATPESGPGTSTEPSEGSAPGTSESATPESGPGSGPGTSESA TPGTSESATPESGPGSEPATSGSETPGTSESATPESGPGTSTEPS EGSAPGSPAGSPTSTEEGTSESATPESGPGSEPATSGSETPGTS ESATPESGPGSPAGSPTSTEEGSPAGSPTSTEEGTSTEPSEGSAP GTSESATPESGPGTSESATPESGPGTSESATPESGPGSEPATSG SETPGSEPATSGSETPGSPAGSPTSTEEGTSTEPSEGSAPGTSTE PSEGSAPGSEPATSGSETPGTSESATP | Barcode underlined |
| RSR-3213 | 7628 | EAGRSASHTPAGLTGP | – |
| Spacer | 96 | GTSESATPES | – |
| EGFR.37 VL | 469 | DIQMTQSPSSLSASVGDRVTITCQASQDISNYLNWYQQKPGK APKLLIYDASNLETGVPSRFSGSGSGTDFTFTISSLQPEDIATY YCQHFDHLPLAFGQGTKVEIK | CDRs underlined |
| Linker | 81 | SESATPESGPGTSPGATPESGPGTSESATP | Barcode underlined |
| EGFR.37 VH | 468 | QVQLQESGPGLVKPSETLSLTCTVSGGSVSSGDYYWTWIRQP PGKGLEWIGHIYYSGNTNYNPSLKSRVTISVDTSKNQFSLKLS SVTAADTAVYYCARDRVTGAFDIWGQGTLVTVSS | CDRs underlined |
| Linker | 87 | GGGGS | – |
| hCD3.318- VL | 127 | ELVVTQEPSLTVSPGGTVTLTCRSSNGAVTSSNYANWVQQK PGQAPRGLIGGTNKRAPGTPARFSGSLLEGKAALTLSGVQPE DEAVYYCALWYPNLWVFGGGTKLTVL | CDRs underlined |
| Linker | 81 | SESATPESGPGTSPGATPESGPGTSESATP | Barcode underlined |
| hCD3.318- VH | 126 | EVQLVESGGGIVQPGGSLRLSCAASGFTFSTYAMNWVRQAP GKGLEWVGRIRTKRNDYATYYADSVKGRFTISRDDSKNTLY LQMNSLKTEDTAVYYCVRHENFGNSYVSWFAHWGQGTLVT VSS | CDRs underlined |
| Spacer | 97 | GTATPESGPG | – |
| RSR-3213 | 7628 | EAGRSASHTPAGLTGP | – |
| X582(F) | 8022 | ATPESGPGTSESATPESGPGSPAGSPTSTEEGTSESATPESGPG SEPATSGSETPGTSESATPESGPGTSTEPSEGSAPGTSTEPSEGS APGTSTEPSEGSAPGTSTEPSEGSAPGTSTEPSEGSAPGTSTEPS EGSAPGSPAGSPTSTEEGTSTEPSEGSAPGTSESATPESGPGSE PATSGSETPGTSESATPESGPGSEPATSGSETPGTSESATPESGP GTSTEPSEGSAPGTSESATPESGPGSPAGSPTSTEEGSPAGSPT STEEGSPAGSPTSTEEGTSESATPESGPGTSTEPSEGSAPGTSES ATPESGPGSEPATSGSETPGTSESATPESGPGSEPATSGSETPG TSESATPESGPGTSTEPSEGSAPGSPAGSPTSTEEGTSESATPES GPGSEPATSGSETPGTSESATPESGPGSPAGSPTSTEEGSPAGS PTSTEEGTSTEPSEGSAPGTSESATPESGPGTSESATPESGPGTS PSATPESGPGSEPATSGSETPGSEPATSGSETPGSPAGSPTSTEE GTSTEPSEGSAPGTSTEPSEGSAPGSEPATSGSETPGTSESAGE PEA | Barcode underlined |

Method of Production of AMX-525

Methods for producing paTCEs proteins are known in the art, e.g., as described in PCT International Patent Publication No. WO2017/040344. For example, paTCE was expressed in *E. coli*, which was transformed with an expression vector encoding the paTCE and grown in fermentation. Fermentation cultures were grown with animal-free complex medium at 37° C. and temperature shifted to 26° C. before phosphate depletion, which triggered induction (PhoA). Target protein was partitioned into the periplasm via an N-terminal secretory leader sequence, which was cleaved during translocation. During collection, fermentation whole broth was centrifuged to pellet the product-containing cells, which were retained and frozen at ≤−70° C. The frozen cell pellet was resuspended and, once homogenous, the resuspension was mechanically lysed. The chilled flocculate was centrifuged (12,000 RCF, 10° C., 30 min) and the supernatant was decanted and retained, while the pellet was discarded. The following day, centrifugation was performed again (12,000 RCF, 10° C., 30 min) and the supernatant was decanted, submicron filtered and purified via a chromatographic process comprising an Anion Exchange (AEX) chromatography step. paTCEproteins and their derivatives were prepared as aqueous solutions and stored frozen at ≤−70° C. and, after thawing, at temperatures between 2° C. and 8° C.

An exemplary nucleotide sequence for the production of AMX-525 is provided below:

(SEQ ID NO: 8229)

```
GCATCTTCGGCGACGCCGGAAAGCGGTCCGGGTACGTCCACCGAACCGAGCGAGGGTAGCG

CTCCGGGCACCAGCGAGTCCGCGACCCCGGAAAGCGGTCCGGGTAGCGGTCCGGGCACCTC

CGAGAGCGCGACCCCGGGCACCTCTGAATCAGCCACCCCGGAGTCTGGCCCAGGTAGCGAG

CCGGCAACCTCTGGCAGCGAAACCCCGGGCACCAGCGAATCCGCGACGCCAGAGAGCGGTC

CGGGCACCTCTACGGAGCCTAGCGAGGGCTCAGCACCAGGTAGCCCTGCAGGTTCCCCGACG

TCAACCGAGGAAGGTACAAGCGAAAGCGCCACCCCTGAGTCGGGCCCTGGCAGCGAACCGG

CAACTAGCGGCAGCGAGACTCCGGGTACCAGCGAGTCTGCTACGCCAGAGAGCGGCCCAGG

TTCGCCAGCGGGTTCGCCGACTAGCACGGAGGAGGGCAGCCCAGCGGGTAGCCCTACCAGC

ACTGAAGAGGGTACGTCCACCGAACCGAGCGAAGGTAGCGCACCAGGTACCTCCGAGTCTG

CCACCCCTGAATCCGGTCCAGGTACCAGCGAATCAGCCACCCCGGAGTCGGGTCCAGGTACG

AGCGAATCTGCTACCCCGGAATCCGGCCCAGGCAGCGAACCTGCTACTAGCGGCAGCGAAA

CGCCGGGCAGCGAACCTGCCACGTCAGGCAGCGAGACGCCGGGTTCCCCTGCAGGCTCCCC

GACCAGCACTGAGGAGGGCACCTCCACCGAACCATCAGAAGGTAGCGCGCCTGGTACGTCA

ACCGAACCTTCCGAGGgcaGCGCACCGGGTTCAGAACCAGCTACGTCTGGGAGCGAGACCCC

GGGCACCTCCGAGTCGGCGACCCCGGAGGCAGGTCGTTCTGCTAGCCATACCCCTGCAGGGT

TAACTGGCCCCGGAACTTCAGAAAGTGCTACACCCGAGTCTGACATCCAGATGACCCAGAGC

CCGAGCAGCCTGAGCGCGAGCGTGGGTGATCGTGTTACCATTACCTGCCAGGCCTCCCAGGA

CATTTCTAACTATCTGAACTGGTACCAGCAAAAGCCGGGTAAAGCGCCGAAGCTGCTGATCT

ATGATGCTTCTAACCTGGAAACGGGTGTTCCGAGCCGTTTCAGCGGTAGCGGCAGCGGTACC

GACTTCACCTTTACCATCAGCAGCCTGCAGCCGGAGGATATTGCGACCTACTATTGCCAGCA

TTTTGATCATCTGCCGCTGGCGTTCGGTCAGGGCACCAAGGTGGAGATCAAATCGGAATCAG

CGACACCTGAATCTGGCCCTGGTACAAGTCCCGGCGCAACGCCCGAATCGGGTCCGGGGAC

GAGTGAATCTGCGACACCGCAGGTGCAACTGCAGGAGAGCGGTCCGGGCCTGGTTAAGCCG

AGCGAAACCCTGAGCCTGACCTGCACCGTGAGCGGTGGCAGCGTGAGCAGCGGCGATTATT

ATTGGACCTGGATTCGTCAGCCGCCGGGCAAGGGTCTGGAGTGGATTGGTCATATTTATTATT

CCGGTAACACCAACTACAACCCGAGCCTGAAAAGCCGTGTGACCATCAGCGTTGACACCAG

CAAGAACCAGTTCAGCCTGAAACTGAGCAGCGTGACCGCGGCGGATACCGCGGTTTACTATT

GCGCGCGTGATCGTGTGACCGGCGCGTTCGACATTTGGGGTCAGGGCACCCTGGTGACGGTT

AGCAGCGGTGGTGGCGGCAGCGAGTTAGTTGTGACCCAAGAGCCGAGCCTGACCGTTAGCC

CGGGTGGTACGGTCACCCTGACGTGCCGTAGCAGCAACGGTGCGGTCACGAGCAGCAACTA

TGCCAATTGGGTCCAGCAGAAACCGGGTCAAGCACCGCGTGGCCTGATCGGCGGCACCAAT
```

-continued

AAACGTGCCCCGGGTACTCCTGCGCGTTTCTCCGGTAGCCTGCTGGAAGGCAAAGCCGCTCT

GACCCTGAGCGGTGTCCAGCCGGAAGATGAAGCGGTGTACTACTGCGCGCTGTGGTATCCGA

ATCTGTGGGTTTTTGGCGGCGGTACCAAGCTGACCGTATTGAGCGAGAGCGCAACGCCAGAG

AGCGGTCCAGGCACCAGCCCAGGTGCCACCCCTGAGAGCGGCCCAGGTACTTCTGAGAGCG

CCACTCCGGAGGTCCAACTGGTGGAGTCTGGTGGTGGCATTGTTCAACCGGGTGGCTCGTTG

CGCCTGAGCTGTGCAGCTAGCGGCTTTACCTTCAGCACCTATGCGATGAATTGGGTTCGTCA

GGCACCGGGTAAGGGCCTGGAATGGGTGGGCCGTATCCGCACCAAGCGCAACGATTACGCG

ACCTACTACGCGGATAGCGTTAAAGGCCGCTTCACGATTAGCCGTGACGATTCCAAGAATAC

GCTGTATCTGCAAATGAACAGCCTGAAAACCGAAGATACCGCGGTGTATTACTGTGTGCGCC

ACGAAAATTTCGGCAACAGCTACGTGAGCTGGTTTGCACATTGGGGTCAGGGCACCCTGGTT

ACGGTGAGCTCCGGTACAGCTACTCCAGAATCAGGACCCGGGGAAGCTGGAAGAAGCGCCT

CACACACACCAGCTGGACTTACAGGCCCGGCTACTCCCGAAAGTGGGCCAGGAACATCAGA

GTCCGCGACCCCGGAAAGCGGTCCGGGTTCTCCAGCTGGCAGCCCGACCTCCACTGAAGAAG

GCACCTCTGAGTCTGCTACCCCTGAATCTGGTCCTGGCTCCGAACCTGCTACCTCTGGTTCCG

AAACTCCAGGTACCTCGGAATCTGCGACTCCGGAATCTGGCCCGGGCACGAGCACGGAGCC

GTCTGAGGGTAGCgcaccAGGTACCAGCACTGAGCCTTCTGAGGGCTCTGCACCGGGTACCTCC

ACGGAACCTTCGGAAGGTTCTGCGCCGGGTACCTCCACTGAGCCATCCGAGGGTTCAGCACC

AGGTACTAGCACGGAACCGTCCGAGGGCTCTGCACCAGGTACGAGCACCGAACCGTCGGAG

GGTAGCGCTCCAGGTAGCCCAGCGGGCTCTCCGACAAGCACCGAAGAAGGCACCAGCACCG

AGCCGTCCGAAGGTTCCGCACCAGGTACAAGCGAGAGCGCGACTCCTGAATCTGGTCCGGGT

AGCGAGCCTGCAACCAGCGGTTCTGAGACGCCGGGCACTTCCGAATCTGCGACCCCGGAGTC

CGGTCCAGGTTCAGAGCCGGCGACGAGCGGTTCGGAAACGCCGGGTACGTCTGAATCAGCC

ACGCCGGAGTCTGGTCCGGGTACCTCGACCGAACCAAGCGAAGGTTCGGCACCGGGTACTA

GCGAGAGCGCAACCCCTGAAAGCGGTCCGGGCAGCCCGGCAGGTTCTCCAACCAGCACCGA

AGAAGGTTCCCCTGCTGGTAGCCCGACCTCTACGGAGGAAGGTAGCCCTGCAGGTTCCCCAA

CTTCTACTGAGGAAGGTACTTCTGAGTCCGCTACCCCAGAAAGCGGTCCTGGTACCTCCACT

GAACCGTCTGAAGGCTCTGCACCAGGCACTTCTGAGTCTGCTACTCCAGAAAGCGGCCCAGG

TTCTGAACCAGCAACTTCTGGCTCTGAGACTCCAGGCACTTCTGAGTCCGCAACGCCTGAAT

CCGGTCCTGGTTCTGAACCAGCTACTTCCGGCAGCGAAACCCCAGGTACCTCTGAGTCTGCG

ACTCCAGAGTCTGGTCCTGGTACTTCCACTGAGCCTAGCGAGGGTTCCGCACCAGGTTCTCC

GGCTGGTAGCCCGACCAGCACGGAGGAGGGTACGTCTGAATCTGCAACGCCGGAATCGGGC

CCAGGTTCGGAGCCTGCAACGTCTGGCAGCGAAACCCCGGGTACCTCCGAATCTGCTACACC

GGAAAGCGGTCCTGGCAGCCCTGCTGGTTCTCCAACCTCTACCGAGGAGGGTTCACCGGCAG

GTAGCCCGACTAGCACTGAAGAAGGTACTAGCACGGAGCCGAGCGAGGGTAGTGCTCCGGG

TACGAGCGAGAGCGCAACGCCAGAGAGCGGTCCAGGCACCAGCGAATCGGCCACCCCTGAG

AGCGGCCCAGGTACTTCACCCTCTGCTACGCCGGAAAGCGGTCCGGGTTCCGAGCCGGCGAC

CAGCGGCTCCGAGACTCCGGGTTCGGAGCCGGCGACCTCCGGCTCGGAAACCCCGGGTAGC

CCGGCTGGTTCTCCGACCAGCACTGAGGAAGGCACCAGCACCGAACCAAGCGAGGGCAGCG

CGCCAGGTACGAGCACCGAACCGAGCGAGGGTTCAGCCCCTGGCTCTGAGCCGGCGACGTC

TGGCTCCGAAACCCCGGGCACCAGCGAGAGCGCTGGTGAACCGGAAGCG

In Vitro Binding Kinetics and Affinity

Kinetic studies were performed by surface plasmon resonance by BIAcore at 37° C. to determine binding $K_D$ of AMX-525 and its metabolites to human and cynomolgus monkey EGFR and CD3. The results are provided in Table 24 and show that the $K_D$ of AMX-525 is greater than either of the singly masked metabolites (1x-N or 1x-C) which is in turn greater that the unmasked metabolite (uTCE). Accordingly, masking decreases binding to EGFR and CD3. Additionally, biding to human and cynomolgus monkey EGFR and CD3 occurs with similar affinity.

Two masks (AMX-525 and AMX-525 NoClvSite) generally protected better than single masked molecules.

In Vitro T Cell Activation

To evaluate the activity of T cells, AMX-525 or its metabolites were co-cultured with healthy human PBMCs together with HT-29 cells. Human PBMCs were incubated with titrations of AMX-525 or metabolites in the presence of HT-29 cells at 37° C. (PMBC: HT-29 cells at 5:1). After 72 hours, PBMCs were analyzed by flow cytometric analysis. Specifically, CD4 and CD8 T cells were interrogated for CD69, CD25, and PD-1 expression. Results for a represen-

TABLE 24

| | Binding kinetics and affinity of AMX-525 and metabolites | | | | | | | | | | | |
| --- | --- | --- | --- | --- | --- | --- | --- | --- | --- | --- | --- |
| | Human EGFR | | | Human CD3 | | | Cyno EGFR | | | Cyno CD3 | | |
| | $K_D$ (nM) | $k_a$ ($M^{-1}s^{-1}$) | $k_d$ ($s^{-1}$) | $K_D$ (nM) | $k_a$ ($M^{-1}s^{-1}$) | $k_d$ ($s^{-1}$) | $K_D$ (nM) | $k_a$ ($M^{-1}s^{-1}$) | $k_d$ ($s^{-1}$) | $K_D$ (nM) | $k_a$ ($M^{-1}s^{-1}$) | $k_d$ ($s^{-1}$) |
| AMX-525 | 0.736 | 1.04E+6 | 7.7E−4 | 57 | 3.1E+6 | 0.18 | 1.048 | 9.1E+5 | 1.0E−3 | 167 | 1.1E+6 | 0.18 |
| AMX-525 (1x-N) | 0.205 | 2.03E+6 | 4.17E−4 | 36 | 4.0E+6 | 0.16 | 0.25 | 1.81E+6 | 4.5E−4 | 47 | 3.2E+6 | 0.15 |
| AMX-525 (1x-C) | 0.184 | 2.0E+6 | 3.6E−4 | 32 | 3.6E+6 | 0.114 | 0.238 | 2.12E+6 | 5.1E−4 | 43 | 2.1E+6 | 0.09 |
| AMX-525 (uTCE) | 0.034 | 6.45E+6 | 2.3E−4 | 29.2 | 4.4E+6 | 0.128 | 0.042 | 4.1E+6 | 1.7E−4 | 28 | 5.0E+6 | 0.14 |

In Vitro Cytotoxicity

In vitro cytotoxicity of AMX-525 was determined in the following cancer cell lines: HT-29 (Colorectal, 22K EGFR/cell), MDA-MB-231 (Breast, 75K EGFR/cell), or A-431 (Epidermal; 590K EGFR/cell) with an Effector to Target (E:T) ratio of 5 to 1. The results are provided Table 25. The results show that the potency is as follows: uTCE >1x-N ≅1x-C >AMX-525>NoClvSite. Therefore, the results demonstrate that AMX-525 exhibits reduced potency compared to unmasked TCE and that two masks provide more protection than one. Unmasked AMX-525 induced potent cytotoxicity at about 3-10 μM in the cell lines tested. Cytotoxicity curves for exemplary donor are provided in FIG. 10A (HT-29), FIG. 10B (MDA-MB-231), and FIG. 10C (A-431).

TABLE 25

| Cytotoxicity of AMX-525 and metabolites in cancer cell lines | | | |
| --- | --- | --- | --- |
| | $EC_{50}$ (nM) - Geometric mean of donors | | |
| AMX-525 | HT-29 | MDA-MB-231 | A-431 |
| uTCE | 0.0096 | 0.0029 | 0.0032 |
| AMX-525 | >300 | 1.0 | 0.030 |
| AMX-525(1x-C) | 1.8 | 0.042 | 0.013 |
| AMX-525(1x-N) | 2.0 | 0.056 | 0.010 |
| AMX-525(NoClvSite) | >300 | >3.0 | 8.5 |
| Fold protection AMX-525/uTCE | >30,000x | 345x | 9.4x |
| Fold protection AMX-525(NoClvSite)/uTCE | >30,000X | >1000x | 2700x |

In Vitro Cytokine Induction

Figures 11A, 11B:
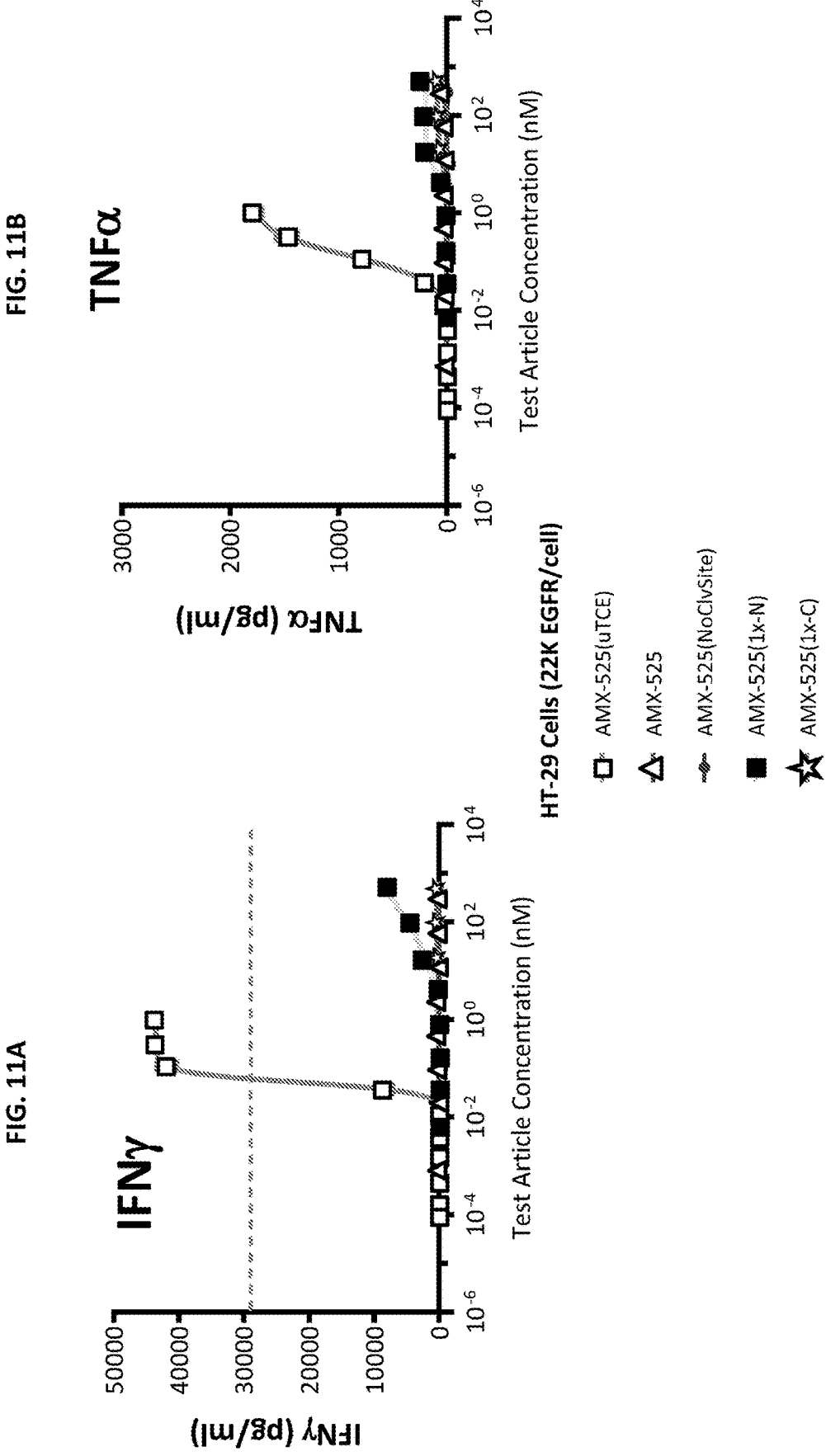
FIG. 11A-FIG. 11D depicts in vitro cytokine induction assays from a representative HT-29 donor. The induction of IFNγ (FIG. 11A), TNFα (FIG. 11B), IL-6 (FIG. 11C), and IL-10 (FIG. 11D) are shown.
Figures 11C, 11D:
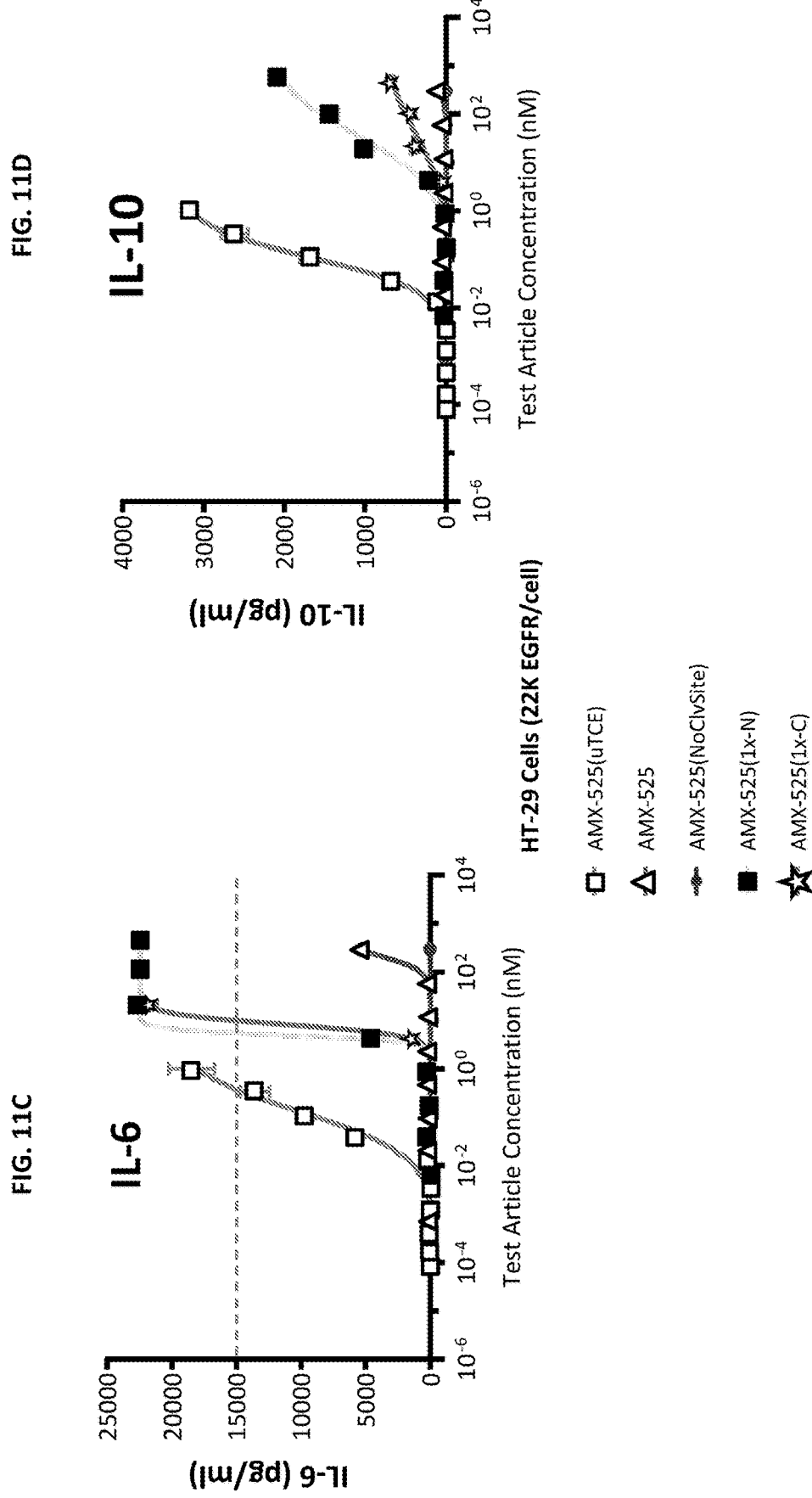
Figure 12:
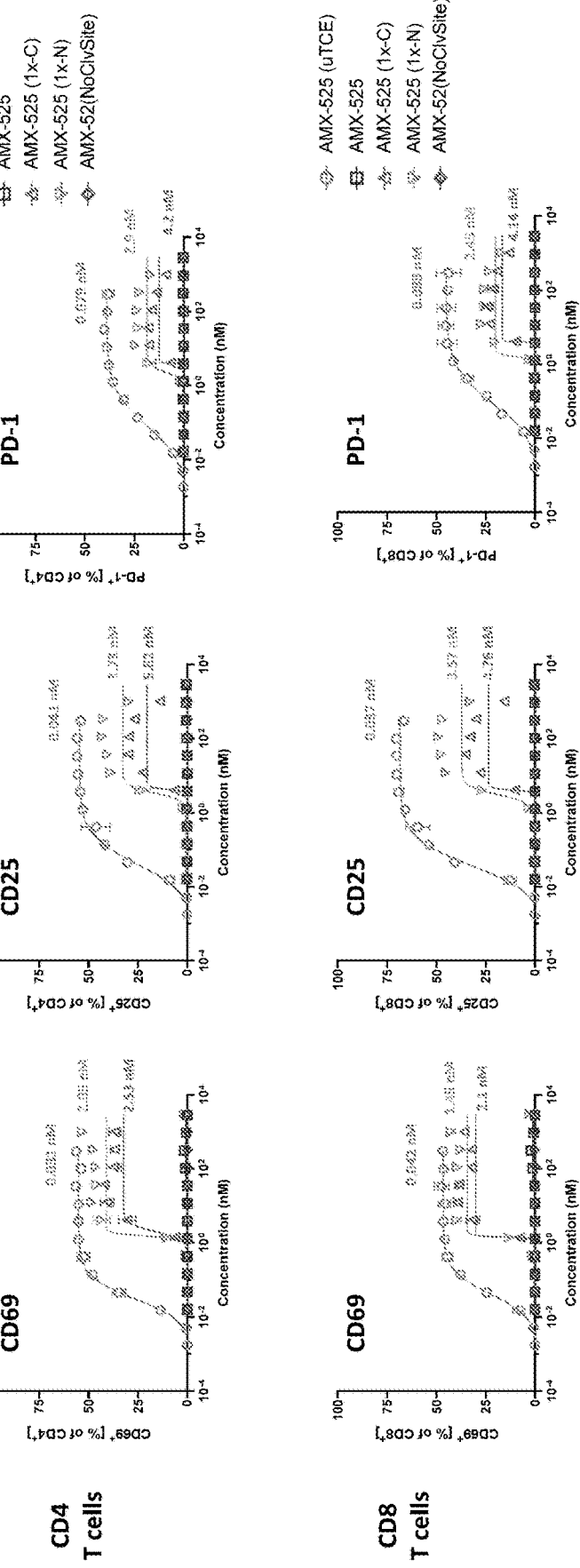
FIG. 12 depicts expression of CD69, CD25, and PD-1 expression in CD4$^+$ and CD8$^+$ T cells.

The supernatants of HT-29 cells after cytotoxic reactions were harvested and in vitro cytokine induction assays were performed. The induction of IFNγ (FIG. 11A), TNFα (FIG. 11B), IL-6 (FIG. 11C), IL-10 (FIG. 11D) from a representative HT-29 donor are shown. In general, AMX-525 (uTCE) potently induced cytokine upregulation while AMX-525 and single-masked metabolites (1x-N and 1x-C) protected against cytokine induction (in line with cytotoxicity results).

tative donor are depicted in FIG. 12. The results show that unmasked AMX-525 (uTCE) resulted in T cell activation as determined by CD69, CD25, and PD-1 upregulation. Additionally, fully masked AMX-525 protected against T cell activation relative to AMX-525 (uTCE). AMX-525 intermediates (1X—C, 1X—N) maintained protection relative to AMX-525 (uTCE); albeit to a lesser extent (in general) than AMX-525.

Cytokine Release Assay

In vitro assessment of cytokine release is a predictive indicator for cytokine release syndrome (CRS). Overall, neither AMX-525 nor AMX-525 (uTCE) elicited significant cytokine induction in the cytokine release assay with human PBMC (Table 26). Stimulation of IL-6 (data not shown) was observed in the soluble treated groups and determined to be an artifact of the experiment based on corresponding non-human primate data and the lack of upregulation of other cytokines, which would be expected for a CRS response.

TABLE 26

| | Cytokine release assay | | | |
| --- | --- | --- | --- | --- |
| | AMX-525 | | AMX-525 (uTCE) | |
| Analyte | Soluble treatment | Wet-coated treatment | Soluble treatment | Wet-coated treatment |
| IL-2 | – | – | – | – |
| IL-4 | – | – | – | – |
| IL-10 | + | – | – | – |
| TNFα | + | – | – | – |
| IFNγ | – | – | – | – |

– No stimulation
+ moderate stimulation (at highest concentrations tested or in single donor)

In Vitro Plasma Stability

Figure 13:
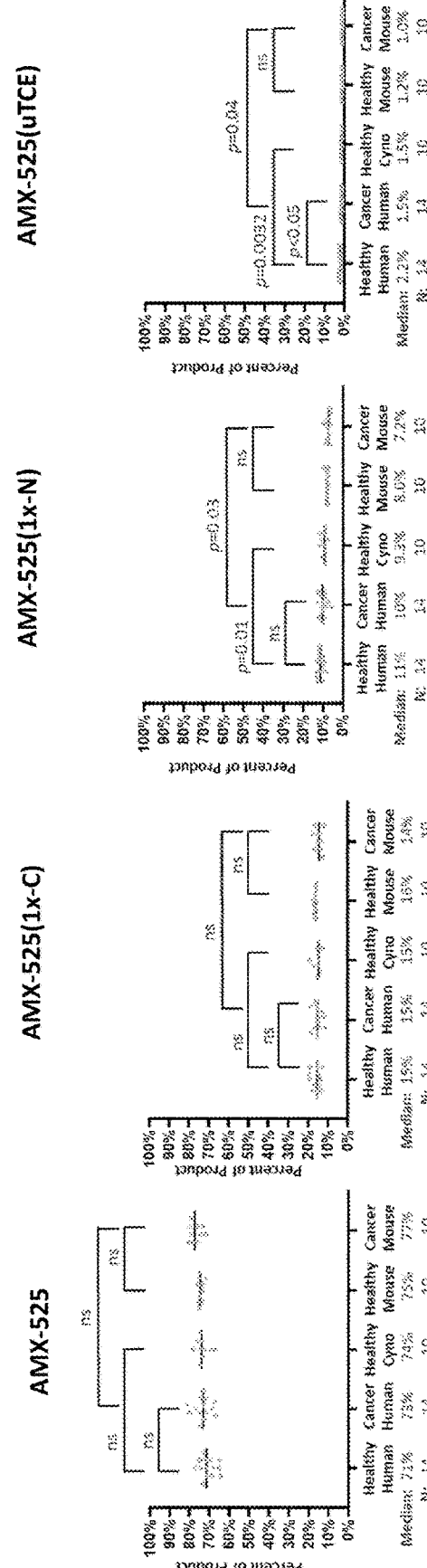
FIG. 13 depicts in vitro plasma stability of AMX-525 from samples in healthy human donors, human cancer donors (8 pancreatic, 2 head and neck, 4 ovarian), healthy cynomolgus monkeys, healthy mice, and tumor-bearing mice (HT-29-implanted CDX).

The in vitro plasma stability of AMX-525 was determined. Fluorescently labeled AMX-525 was spiked into various plasma samples at 200 nM. The samples were healthy human donors, human cancer donors (8 pancreatic, 2 head and neck, 4 ovarian), healthy cynomolgus monkeys, healthy mice, and tumor-bearing mice (HT-29-implanted CDX). The plasma samples were incubated at 37° C. for up to 7 days. The relative levels of AMX-525 and cleavage product was quantified by SDS-PAGE and LI-COR detection after 3 & 7 days, with the 7-day timepoint shown in FIG. 13. The results show that plasma stability of AMX-525 and its metabolites is similar between humans, monkeys, and mice. Accumulation of fully cleaved and intermediate prod- AMX-525-NoClvSite group showed non-statistically significant TGI of 15% (p=0.885). The protease-activatable AMX-525 exhibited a greater anti-tumor effect at a dose of 0.5 mg/kg (65% TGI) than that observed with AMX-500-NoClvSite at the 6 times greater QW dose of 3 mg/kg (15% TGI), indicating that the ELNN masks of AMX-525 may be removed in the tumor micro-environment, releasing the potent unmasked TCE.

TABLE 27

| | | | | | | | Day 24 Results | | |
| | | | | | | | | | |
| | | | Dose | Dosing | | Dosing | | | Tumor |
| | | | Level | Volume | | Frequency and | | | Regression $^{c\ (\#/n)}$ |
| Group | N | Treatment | (mg/kg) | (mL/kg) | Route | Duration | $\pm BW^a$ | $TGI^b$ | |
|---|---|---|---|---|---|---|---|---|---|
| 1 | 6 | Vehicle diluent, no PBMC | — | 10 | IV | QW × 3 weeks | 6.3% | — | 0/6 |
| 2 | 6 | Vehicle diluent, PBMC | — | 10 | IV | QW × 3 weeks | 12.7% | — | 0/6 |
| 3 | 6 | AMX-500 | 0.5 | 10 | IV | QW × 3 weeks | 11.4% | 65% | 0/6 |
| 4 | 6 | AMX-500 | 1.0 | 10 | IV | QW × 3 weeks | 11.2% | 73% | 0/6 |
| 5 | 6 | AMX-500 | 3.0 | 10 | IV | QW × 3 weeks | 8.0% | 75% | 1/6 |
| 6 | 6 | AMX-500-NoClvSite | 3.0 | 10 | IV | QW × 3 weeks | 11.3% | 15% | 0/6 |
| 7 | 6 | AMX-500(uTCE) | 0.3 | 10 | IV | QW × 3 weeks | 14.5% | 108% | 5/6 |

Abbreviations: BW, body weight; IV, intravenous; NA, not applicable; PBMC, peripheral blood mononuclear cells; QW, one time a week; TGI, tumor growth inhibition.
$^a \pm BW$ % = percent body weight change compared with body weight at the start of treatment
$^b TGI$ (%) = (Vc-Vt)/(Vc-Vo) × 100, where Vc and Vt are the mean tumor volume of the control and treated groups at the end of the study (respectively) and Vo is the mean tumor volume of the control group at the start of dosing. TGI was calculated versus Group 2 (Vehicle diluent, PBMC).
$^c$ Tumor regression was defined as tumor volume at study end (Day 24), which is less than the starting tumor volume prior to dosing.

ucts was observed over time. Overall, AMX-525 is relatively stable in healthy and cancer patient plasma.

In Vivo Efficacy in EGFR-Expressing Tumor Bearing Mice

AMX-525 was evaluated in three in vivo cell line-derived mouse xenograft models which include MDA-MB-231 (Breast; EGFR receptor density: 75K/cell), HT-29 (Colorectal; EGFR receptor density: 22K/cell), and LoVo (Colorectal; EGFR receptor density: 28K/cell).

The in vivo efficacy of AMX-525, AMX-525-NoClvSite, and AMX-525 (uTCE) was evaluated in the human PBMC-engrafted HT-29 human colorectal tumor model in nonobese diabetic (NOD).Cg-Prkdc$^{scid}$ 112$^{rgtmlwjl}$/SzJ (NSG) mice.

Figure 14:
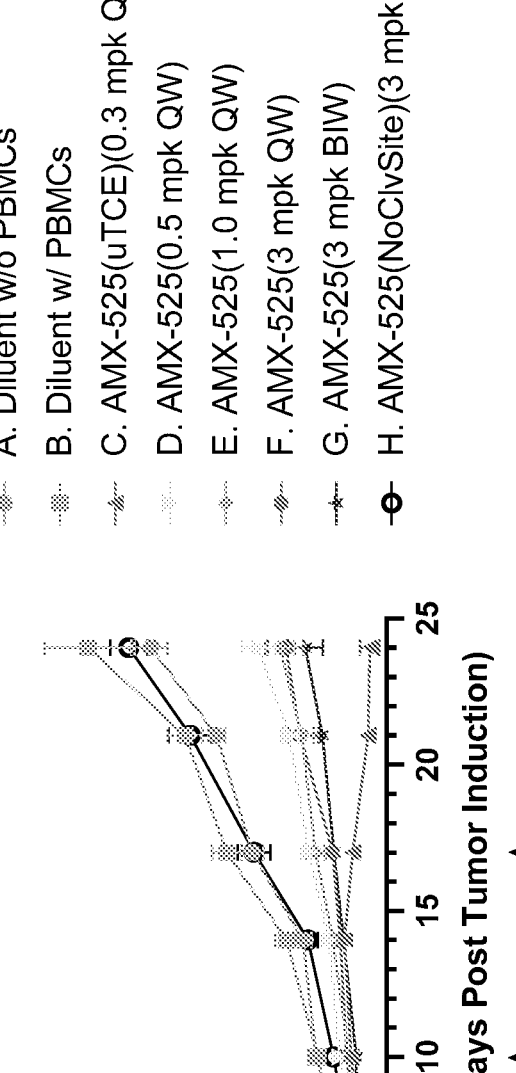
FIG. 14 depicts tumor growth curves in mice bearing HT-29 tumors.

Mice bearing HT-29 tumors were randomized into 7 groups of 6 mice each and administered vehicle diluent (no PBMC), vehicle diluent (PBMC), 0.5 mg/kg AMX-525, 1 mg/kg AMX-525, 3 mg/kg AMX-525, 3 mg/kg AMX-525-NoClvSite, and 0.3 mg/kg AMX-525 (uTCE) by weekly bolus IV. Experimental design and results summary are shown in Table 27. Tumor growth curves between treatment initiation (Day 4) and study termination (Day 24) are shown in FIG. 14.

All test articles were well tolerated by the experimental animals, as evidenced by the similar average body weight change (% BW) in the range of 6.3-14.5% across all experimental groups.

AMX-525 treatment promoted anti-tumor activity at all dose levels evaluated when compared with the applicable PBMC-engrafted control, Group 2. At Day 24, the end of the study, AMX-525 at a dose level of 3 mg/kg QW showed TGI of 75% (p<0.0001), while the intermediate (1.5 mg/kg QW) and lowest (0.5 mg/kg QW) dose levels showed TGIs of 73% (p=0.0001) and 65% (p=0.0001), respectively. The The in vivo efficacy of AMX-525, AMX-525-NoClvSite, and AMX-525 (uTCE) was evaluated in the human PBMC-engrafted LoVo human colorectal tumor model in nonobese diabetic (NOD).Cg-Prkdc$^{scid}$ 12$^{rgtmlWjl}$/SzJ (NSG) mice.

Figure 15:
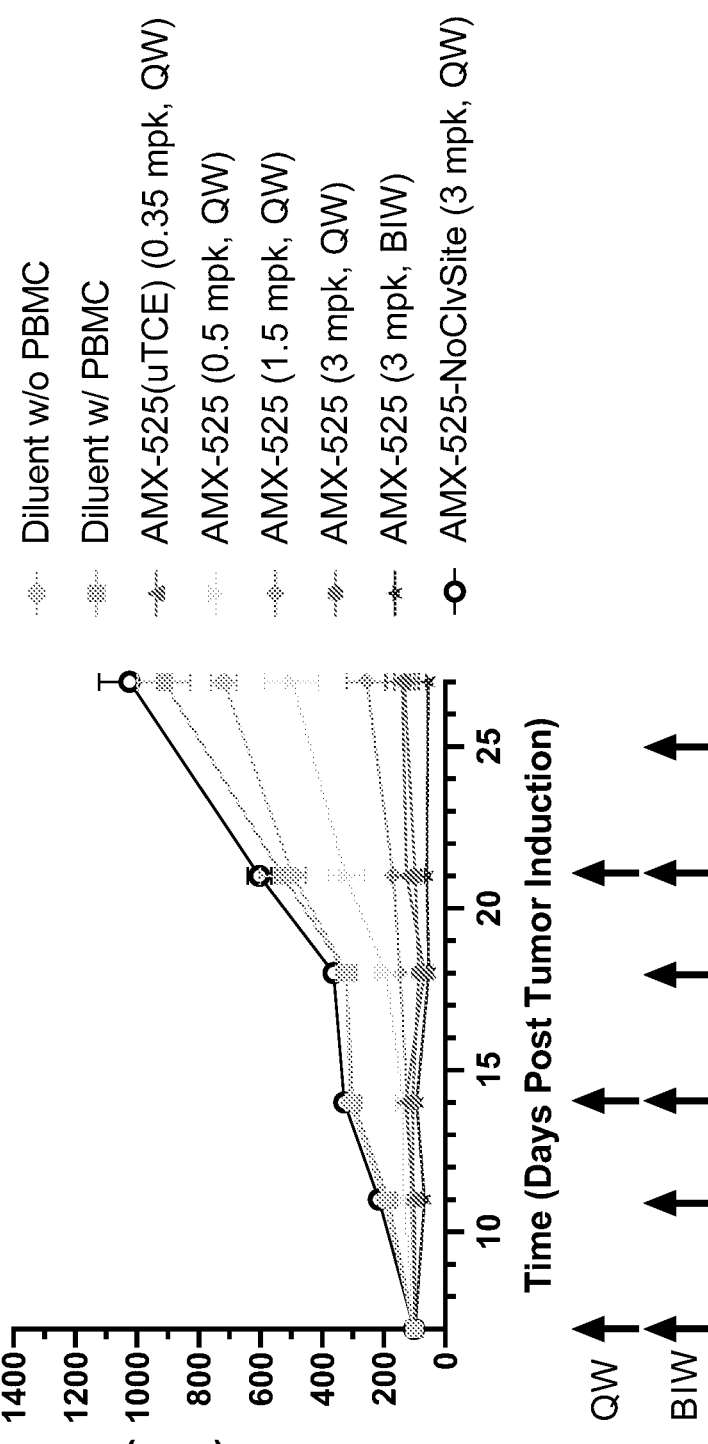
FIG. 15 depicts tumor growth curves in mice bearing LoVo tumors.

Mice bearing LoVo tumors were randomized into 7 groups of 8 mice each and administered vehicle diluent (no PBMC), vehicle diluent (PBMC), 0.5 mg/kg AMX-525, 1 mg/kg AMX-525, 3 mg/kg AMX-525, 3 mg/kg AMX-525-NoClvSite, and 0.35 mg/kg AMX-525 (uTCE) by weekly bolus IV. Experimental design and results summary are shown in Table 28. Tumor growth curves between treatment initiation (Day 5) and study termination (Day 27) are shown in FIG. 15.

All test articles were well tolerated by the experimental animals, as evidenced by the similar average body weight loss (BWL) in the range of 1.1-6.4% across all experimental groups engrafted with PBMCs.

AMX-525 treatment promoted anti-tumor activity at all dose levels evaluated when compared with the applicable PBMC-engrafted control, Group 2. At Day 27, the end of the study, AMX-525 displayed dose-dependent TGI with the highest dose level of 3 mg/kg QW showing TGI of 95% (p<0.0001), while the intermediate (1.5 mg/kg QW) and lowest (0.5 mg/kg QW) dose levels showed TGIs of 75% (p=0.0001) and 36% (p=0.0001), respectively. At Day 27, AMX-525 treatment at the highest tested dose of 3 mg/kg QW had similar TGI (95% TGI) as the enzymatically cleaved and activated AMX-525 (uTCE) (94% TGI) using a 0.35 mg/kg QW dose. The protease-activatable AMX-525 exhibited a greater anti-tumor effect at a dose of 0.5 mg/kg (64% TGI) than that observed with AMX-500-NoClvSite at a QW dose of 3 mg/kg (52% TGI), indicating that the ELNN masks of AMX-500 may be removed in the tumor micro-environment, releasing the potent unmasked TCE.

Figure 18:
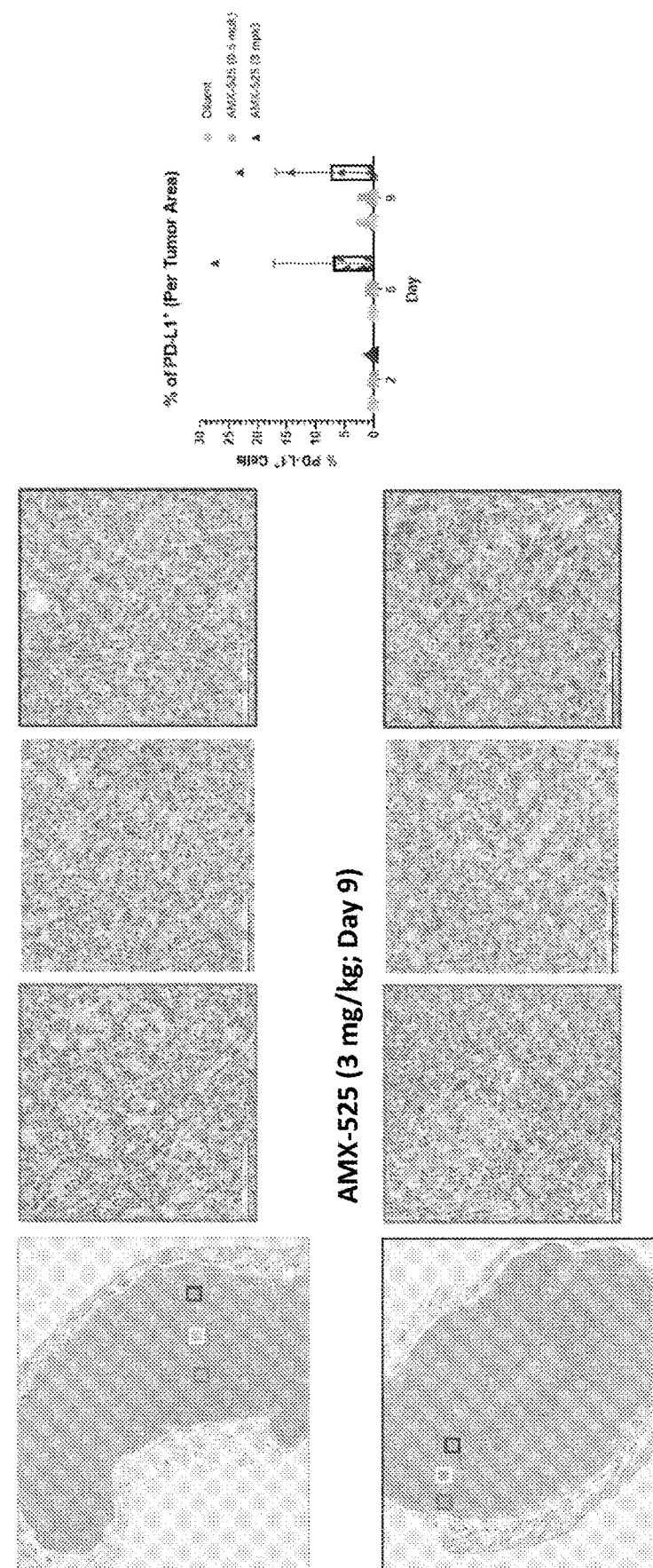
FIG. 18 depicts IHC images and corresponding quantification of PD-L1 expression in tumor tissue from a LoVo xenograft mouse model.
Figure 19:
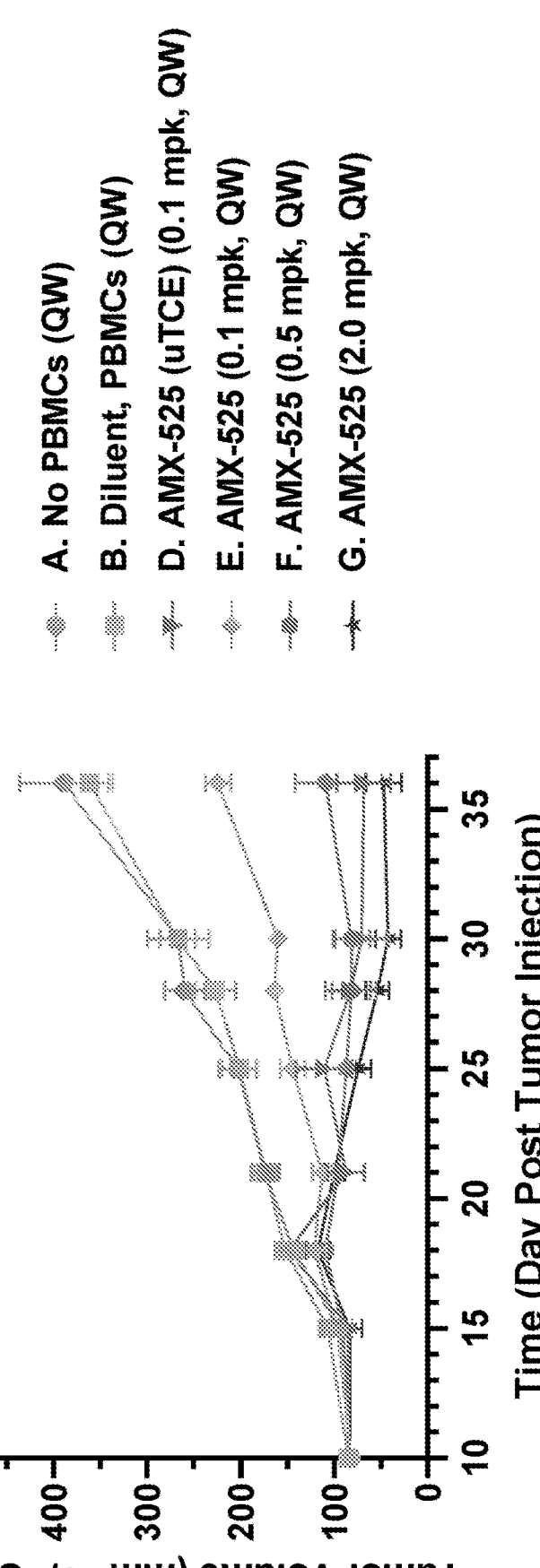
FIG. 19 depicts tumor growth curves in mice bearing MDA-MB-231 tumors.

Immunohistochemistry (IHC) was performed on tumor tissue from the LoVo xenograft mouse model at days 2, 6, and 9. IHC shows that AMX-525 recruits CD8$^+$ T cells to LoVo xenograft tumor in a dose and time dependent manner (FIG. 16). Likewise, AMX-525 recruits CD4$^+$T cells to LoVo xenograft tumor in a dose and time dependent manner (FIG. 17). Additionally, PD-L1 upregulation on tumor and immune cells was observed in AMX-525 treated tumors (FIG. 18).

mental design and results summary are shown in Table 29. Tumor growth curves between treatment initiation (Day 5) and study termination (Day 27) are shown in FIG. 19.

All test articles were well tolerated by the experimental animals, as evidenced by the similar 0.5-5.5% average body weight gain in the range of 0.5-5.5% across all experimental groups.

AMX-525 treatment promoted anti-tumor activity at all dose levels evaluated when compared with the applicable PBMC-engrafted control, Group 2. At Day 36, the end of the

TABLE 28

Study Design and Results Summary, LoVo

| | | | Study Design | | | | Day 27 Results | | |
|---|---|---|---|---|---|---|---|---|---|
| | | | Dose | Dosing | | Dosing | | | |
| Group | N | Treatment | Level (mg/kg) | Volume (mL/kg) | Route | Frequency and Duration | ±BW$^a$ | TGI$^b$ | Tumor Regression $^{c\ (\#/n)}$ |
| 1 | 8 | Vehicle diluent, no PBMC | — | 10 | IV | QW × 3 weeks | −2.7% | | 8/0 |
| 2 | 8 | Vehicle diluent, PBMC | — | 10 | IV | QW × 3 weeks | 1.1% | | 0/8 |
| 3 | 8 | AMX-500 | 0.5 | 10 | IV | QW × 3 weeks | 5.4% | 36% | 0/8 |
| 4 | 8 | AMX-500 | 1.5 | 10 | IV | QW × 3 weeks | 3.5% | 75% | 1/8 |
| 5 | 8 | AMX-500 | 3.0 | 10 | IV | QW × 3 weeks | 6.4% | 95% | 3/8 |
| 6 | 8 | AMX-500-NoClvSite | 3.0 | 10 | IV | QW × 3 weeks | 1.9% | −50% | 0/8 |
| 7 | 8 | AMX-500(uTCE) | 0.35 | 10 | IV | QW × 3 weeks | 5.4% | 94% | 3/8 |

Abbreviations: BW, body weight; IV, intravenous; NA, not applicable; PBMC, peripheral blood mononuclear cells; QW, one time a week; TGI, tumor growth inhibition.
$^a$#BW % = percent body weight change compared with body weight at the start of treatment
$^b$TGI (%) = (Vc-Vt)/(Vc-Vo) × 100, where Vc and Vt are the mean tumor volume of the control and treated groups at the end of the study (respectively) and Vo is the mean tumor volume of the control group at the start of dosing. TGI was calculated versus Group 2 (Vehicle diluent, PBMC).
$^c$ Tumor regression was defined as tumor volume at study end (Day 27), which is less than the starting tumor volume prior to dosing.

The in vivo efficacy of AMX-525, AMX-525-NoClvSite, and AMX-525 (uTCE) was evaluated in the human PBMC-engrafted MDA-MB-231 human breast tumor model in nonobese diabetic (NOD).Cg-Prkdc$^{scid}$ I12$^{rgtmlWjl}$/SzJ (NSG) mice.

Mice bearing MDA-MB-231 tumors were randomized into 6 groups of 8 mice each and administered vehicle diluent (no PBMC), vehicle diluent (PBMC), 0.1 mg/kg AMX-525, 0.5 mg/kg AMX-525, 2 mg/kg AMX-525, and 0.1 mg/kg AMX-525 (uTCE) by weekly bolus IV. Experistudy, AMX-525 displayed dose-dependent TGI with the highest dose level of 2 mg/kg QW showing TGI of 114% (p<0.0001), while the intermediate (0.5 mg/kg QW) and lowest (0.1 mg/kg QW) dose levels showed TGIs of 91% (p=0.0001) and 50% (p=0.0001), respectively. At Day 27, AMX-525 treatment at the highest tested dose of 3 mg/kg QW had similar TGI (114% TGI) as the enzymatically cleaved and activated AMX-525 (uTCE) (106% TGI) using a 0.1 mg/kg QW dose.

TABLE 29

Study Design and Results Summary, MDA-MB-231

| | | | Study Design | | | | Day 36 Results | | |
|---|---|---|---|---|---|---|---|---|---|
| | | | Dose | Dosing | | Dosing | | | |
| Group | N | Treatment | Level (mg/kg) | Volume (mL/kg) | Route | Frequency and Duration | ±BW$^a$ | TGI$^b$ | Tumor Regression $^{c\ (\#/n)}$ |
| 1 | 8 | Vehicle diluent, no PBMC | — | 10 | IV | QW × 3 weeks | 2.1% | | 0/8 |
| 2 | 8 | Vehicle diluent, PBMC | — | 10 | IV | QW × 3 weeks | 2.0% | | 0/8 |
| 3 | 8 | AMX-500 | 0.1 | 10 | IV | QW × 3 weeks | 5.5% | 50% | 0/8 |
| 4 | 8 | AMX-500 | 0.5 | 10 | IV | QW × 3 weeks | 4.3% | 91% | 1/8 |

TABLE 29-continued

| | | | | | Study Design | | | Day 36 Results | | |
| | | | Dose | Dosing | | Dosing | | | | |
| Group | N | Treatment | Level (mg/kg) | Volume (mL/kg) | Route | Frequency and Duration | ±BW[a] | TGI[b] | Tumor Regression [c (#/n)] |
| 5 | 8 | AMX-500 | 2 | 10 | IV | QW × 3 weeks | 2.3% | 114% | 5/8 |
| 6 | 8 | AMX-500(uTCE) | 0.1 | 10 | IV | QW × 3 weeks | 0.5% | 106% | 5/8 |

Abbreviations: BW, body weight; IV, intravenous; NA, not applicable; PBMC, peripheral blood mononuclear cells; QW, one time a week; TGI, tumor growth inhibition.
[a]BW % = percent body weight change compared with body weight at the start of treatment
[b]TGI (%) = (Vc-Vt)/(Vc-Vo) × 100, where Vc and Vt are the mean tumor volume of the control and treated groups at the end of the study (respectively) and Vo is the mean tumor volume of the control group at the start of dosing. TGI was calculated versus Group 2 (Vehicle diluent, PBMC).
[c] Tumor regression was defined as tumor volume at study end (Day 36), which is less than the starting tumor volume prior to dosing.

In Vivo Tumor Distribution and Tumor Cleavage

The tumor tissue distribution and masking polypeptide cleavage of AMX-525 was determined. Tumor-bearing mice were administered fluorescently labeled AMX-525. Five patient-derived xenograft models of non-small cell lung cancer were evaluated (n=2 mice per model) and select healthy tissues (tumor, heart, lung, liver) and plasma was collected 48 hours post-administration. A control paTCE was spiked in during homogenization of tissues. Relative abundance of AMX-525 and cleavage products were quantified by SDS-PAGE and LI-COR detection. AMX-525 distributed to healthy tissue and xenografted tumor within 48 hours after administration. As shown in Table 30, AMX-525 cleavage intermediates (1X—N and 1X—C) and fully unmasked AMX-525 (uTCE) were detected in the NSCLC tumor xenograft. By contrast, minimal cleavage of AMX-525 was observed in plasma or healthy tissue.

TABLE 30

| | | In vivo cleavage (% relative abundance) | | |
| | AMX-525 | 1X-N | 1X-C | uTCE |
| Tumor | 56% | 6.1% | 4.4% | 34% |
| Heart | 99% | BLQ | BLQ | BLQ |
| Lung | 99% | BLQ | BLQ | BLQ |
| Liver | 99% | BLQ | BLQ | BLQ |
| Plasma | 97% | 1.4% | 1.4% | BLQ |

BLQ = below level of quantification; noted if ≥50% of animals are BLQ

Combination with PD-1 and PD-L1 Inhibitors

As described above, PD-1 was upregulated on CD4$^+$ and CD8$^+$ T cells following treatment with AMX-525 in an in vitro T cell activation assay (FIG. 12). Also as described above, in a LoVo mouse xenograft tumor model, PD-L1 was upregulated on tumor and immune cells in AMX-525 treated tumors (FIG. 18). This suggests administering an EGFR-targeted paTCE such as AMX-525 with an anti-PD-1 or anti-PD-L1 inhibitor.

In Vivo Efficacy in Mice-Pembrolizumab Combination

In addition, the in vivo efficacy of AMX-525 or AMX-525-NoClvSite in combination with an anti-PD-1 antibody, pembrolizumab, was evaluated in the human peripheral blood mononuclear (PBMC)-engrafted SK—OV-3 human ovarian tumor model in NOD.Cg-Prkdc$^{scid}$ H2-K1$^{tlBpe}$ H2-Ab1$^{emlMvw}$ H2-D1$^{tmlBpe}$ 112$^{rgtmlWjl}$/SzJ (NSG-MHC I/II DKO) mice.

Figure 20:
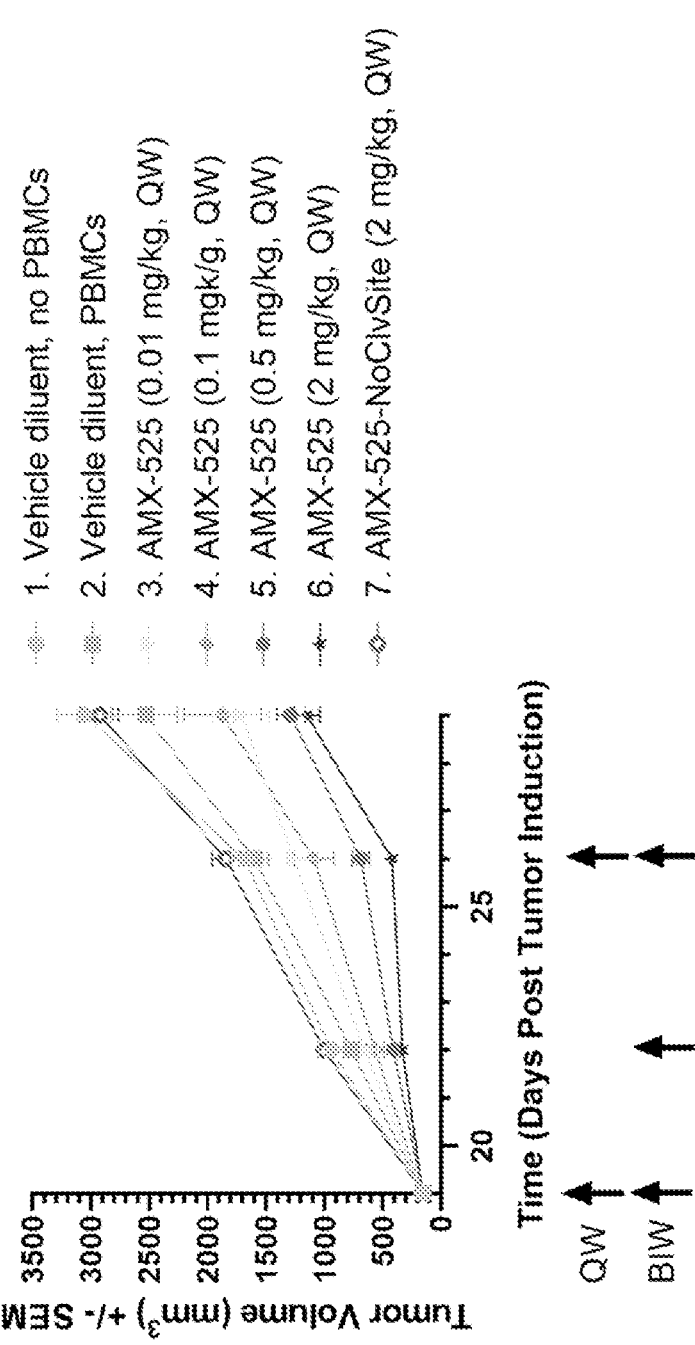
FIG. 20 depicts the efficacy of AMX-525 as indicated by tumor growth curves in mice bearing SK—OV-3 ovarian tumors. NSG-MHC I/II DKO mice were inoculated subcutaneously with SK—OV-3 tumor cells (Day 0), engrafted with PBMCs (Day 18), and treated with the indicated test articles on days denoted by the arrows.
Figure 21:
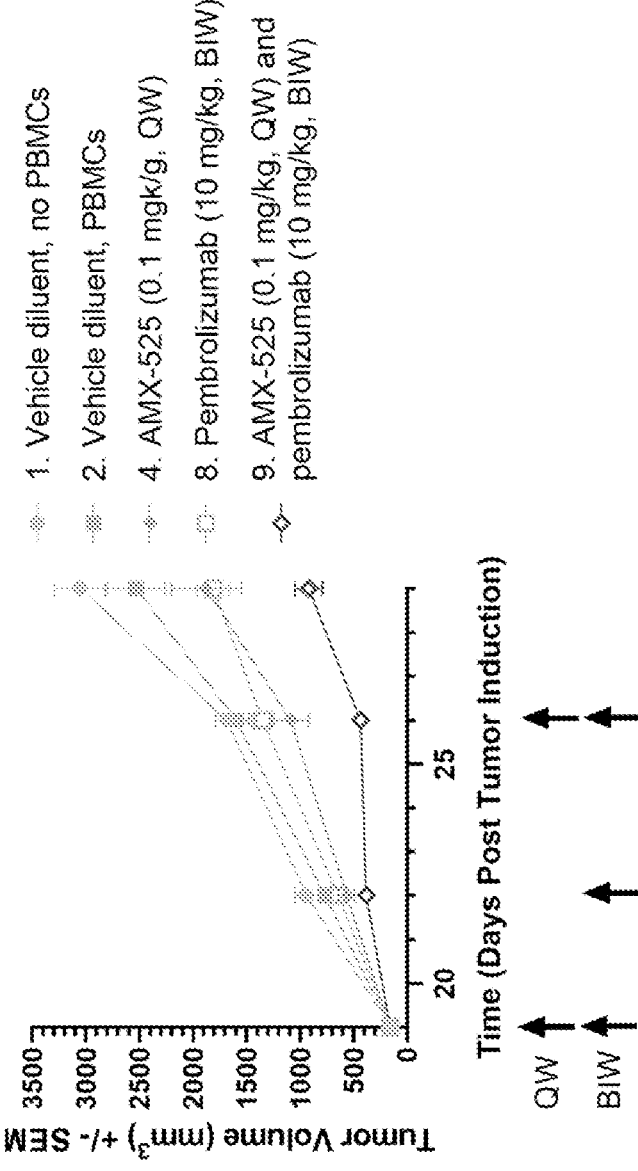
FIG. 21 depicts the efficacy of the combination of AMX-525 and an anti-PD-1 antibody, Pembrolizumab, as indicated by tumor growth curves in mice bearing SK—OV-3 ovarian tumors. NSG-MHC I/II DKO mice were inoculated subcutaneously with SK—OV-3 tumor cells (Day 0), engrafted with PBMCs (Day 18), and treated with the indicated test articles on days denoted by the arrows.

Mice were inoculated subcutaneously with 5×10$^6$SK—OV-3 tumor cells (Day 0). On Day 18, randomization was performed using a tumor volume-stratified randomization method and were engrafted with 1×10$^7$PBMCs. Mice were administered either vehicle diluent (no PBMCs), vehicle diluent (with PBMCs), 0.01 mg/kg AMX-525, 0.1 mg/kg AMX-525, 0.5 mg/kg AMX-525, 2 mg/kg AMX-525, 2 mg/kg AMX-525-NoClvSite, 10 mg/kg pembrolizumab, or both 0.1 mg/kg AMX-525 and 10 mg/kg pembrolizumab for 2 weeks. AMX-525 and AMX-525-NoClvSite were administered once weekly via bolus intravenous (IV) lateral tail vein injection. Pembrolizumab was administered twice weekly via bolus intraperitoneal (IP) injection. Experimental design and results summary are shown in Table 31Table. Tumor growth curves between treatment initiation (Day 19) and study termination (Day 29) of AMX-525 (FIG. 20) and in combination with pembrolizumab (FIG. 21) are provided. All test agents were well tolerated by test animals, as shown by the body weight gain (BWG) across all groups.

At Day 29, AMX-525 treatment promoted anti-tumor activity at all dose levels with tumor growth inhibitions (TGIs) in the range of 27.8% to 58.2% when compared with the applicable PBMC-engrafted control, Group 2. AMX-525-NoClvSite did not exhibit anti-tumor activity, suggesting AMX-525's TGI is cleavage dependent. AMX-525 and pembrolizumab have greater anti-tumor activity when combined (Group 9:67.9% TGI) than single-agent 0.1 mg/kg AMX-525 (Group 4:27.8% TGI) and single-agent pembrolizumab (Group 8:30.4% TGI).

TABLE 31

| | | | | | | Dosing | Day 29 Results | |
| | | | | | | | BWG | TGI[a] |
| Group | N | Treatment | Dose Level (mg/kg) | Dosing Volume (mL/kg) | Route | Frequency, Duration | (%) | (%) |
|---|---|---|---|---|---|---|---|---|
| 1 | 8 | Vehicle diluent, no PBMCs | NA | 10 | Bolus IV | QW × 2 weeks | 9.8 | NA |
| 2 | 8 | Vehicle diluent, PBMCs | NA | 10 | Bolus IV | QW × 2 weeks | 2.9 | NA |
| 3 | 8 | AMX-525 | 0.01 | 10 | Bolus IV | QW × 2 weeks | 6.4 | 34.6 |
| 4 | 8 | AMX-525 | 0.1 | 10 | Bolus IV | QW × 2 weeks | 7.5 | 27.8 |
| 5 | 8 | AMX-525 | 0.5 | 10 | Bolus IV | QW × 2 weeks | 4.2 | 52.4 |
| 6 | 8 | AMX-525 | 2 | 10 | Bolus IV | QW × 2 weeks | 9.1 | 58.2 |
| 7 | 8 | AMX-525-NoClvSite | 2 | 10 | Bolus IV | QW × 2 weeks | 3.6 | −16.5 |
| 8 | 8 | Pembrolizumab | 10 | 10 | Bolus IP | BIW × 2 weeks | 8.4 | 30.4 |
| 9 | 8 | AMX-525 and pembrolizumab | 0.1 and 10 | 10 and 10 | Bolus IV and IP | QW × 2 weeks and BIW × 2 weeks | 7.1 | 67.9 |

Abbreviations: BIW, twice weekly; BWG, body weight gain compared with body weight at the start of treatment; IP, intraperitoneal; IV, intravenous; NA, not applicable; PBMC, peripheral blood mononuclear cell; QW, once per week; TGI, tumor growth inhibition.

[a]TGI (%) = Vc-Vt)/(Vc-Vo) × 100, where Vc and Vt are the mean tumor volume of the control and treated groups at the end of the study (respectively) and Vo is the mean tumor volume of the control group at the start of dosing. TGI was calculated vs Group 2: vehicle diluent, PBMCs.

While preferred embodiments of the present invention have been shown and described herein, it will be obvious to those skilled in the art that such embodiments are provided by way of example only. It is not intended that the invention be limited by the specific examples provided within the specification. While the invention has been described with reference to the aforementioned specification, the descriptions and illustrations of the embodiments herein are not meant to be construed in a limiting sense. Numerous variations, changes, and substitutions will now occur to those skilled in the art without departing from the invention. Furthermore, it shall be understood that all aspects of the invention are not limited to the specific depictions, configurations or relative proportions set forth herein which depend upon a variety of conditions and variables. It should be understood that various alternatives to the embodiments of the invention described herein may be employed in practicing the invention. It is therefore contemplated that the invention shall also cover any such alternatives, modifications, variations or equivalents. It is intended that the following claims define the scope of the invention and that methods and structures within the scope of these claims and their equivalents be covered thereby.

SEQUENCE LISTING (8290 sequences)

SEQ ID NO: 1 - protein, 14 aa, synthetic construct
RSSNGAVTSSNYAN

SEQ ID NO: 2 - protein, 14 aa, synthetic construct
RSSNGEVTTSNYAN

SEQ ID NO: 3 - protein, 14 aa, synthetic construct
RSSTGAVTTSNYAN

SEQ ID NO: 4 - protein, 7 aa, synthetic construct
GTNKRAP

SEQ ID NO: 5 - protein, 7 aa, synthetic construct
GTIKRAP

SEQ ID NO: 6 - protein, 9 aa, synthetic construct
ALWYPNLWV

SEQ ID NO: 7 - protein, 9 aa, synthetic construct
ALWYSNLWV

SEQ ID NO: 8 - protein, 10 aa, synthetic construct
GFTFNTYAMN

SEQ ID NO: 9 - protein, 19 aa, synthetic construct
RIRSKYNNYATYYADSVKD

SEQ ID NO: 10 - protein, 14 aa, synthetic construct
HENFGNSYVSWFAH

SEQ ID NO: 11 - protein, 14 aa, synthetic construct
HGNFGNSYVSWFAY

SEQ ID NO: 12 - protein, 10 aa, synthetic construct
GFTFSTYAMN

SEQ ID NO: 13 - protein, 19 aa, synthetic construct
RIRTKRNNYATYYADSVKG

SEQ ID NO: 14 - protein, 19 aa, synthetic construct
RIRTKRNDYATYYADSVKG

SEQ ID NO: 15-47 - skipped (33 entries)

SEQ ID NO: 48 - protein, 6 aa, synthetic construct
HHHHHH

SEQ ID NO: 49 - protein, 8 aa, synthetic construct
HHHHHHHH

SEQ ID NO: 50 - skipped

SEQ ID NO: 51 - protein, 22 aa, synthetic construct
ELVVTQEPSLTVSPGGTVTLTC

SEQ ID NO: 52 - protein, 15 aa, synthetic construct
WVQQKPGQAPRGLIG

SEQ ID NO: 53 - protein, 32 aa, synthetic construct
GTPARFSGSLLGGKAALTLSGVQPEDEAVYYC

SEQ ID NO: 54 - protein, 32 aa, synthetic construct
GTPARFSGSSLGGKAALTLSGVQPEDEAVYYC

SEQ ID NO: 55 - protein, 32 aa, synthetic construct
GTPARFSGSLLGGSAALTLSGVQPEDEAVYYC

SEQ ID NO: 56 - protein, 32 aa, synthetic construct
GTPARFSGSSLGGSAALTLSGVQPEDEAVYYC

SEQ ID NO: 57 - protein, 32 aa, synthetic construct
GTPARFSGSLLGGKAALTLSGVQPEDEAEYYC

SEQ ID NO: 58 - protein, 32 aa, synthetic construct
GTPARFSGSSLGGSAALTLSGVQPEDEAEYYC

SEQ ID NO: 59 - protein, 10 aa, synthetic construct
FGGGTKLTVL

SEQ ID NO: 60 - protein, 25 aa, synthetic construct
EVQLLESGGGIVQPGGSLKLSCAAS

SEQ ID NO: 61 - protein, 25 aa, synthetic construct
EVQLQESGGGIVQPGGSLKLSCAAS

SEQ ID NO: 62 - protein, 25 aa, synthetic construct
EVQLQESGGGLVQPGGSLKLSCAAS

SEQ ID NO: 63 - protein, 25 aa, synthetic construct
EVQLLESGGGLVQPGGSLKLSCAAS

SEQ ID NO: 64 - protein, 14 aa, synthetic construct
WVRQAPGKGLEWVA

SEQ ID NO: 65 - protein, 32 aa, synthetic construct
RFTISRDDSKNTVYLQMNNLKTEDTAVYYCVR

SEQ ID NO: 66 - protein, 32 aa, synthetic construct
RFTISRDDSKNTAYLQMNNLKTEDTAVYYCVR

SEQ ID NO: 67 - protein, 11 aa, synthetic construct
WGQGTLVTVSS

SEQ ID NO: 68 - protein, 10 aa, synthetic construct
SPATSGSTPE

SEQ ID NO: 69 - protein, 8 aa, synthetic construct
GSAPATSE

SEQ ID NO: 70 - protein, 9 aa, synthetic construct
GSAPGTATE

SEQ ID NO: 71 - protein, 7 aa, synthetic construct
GSAPGTE

SEQ ID NO: 72 - protein, 8 aa, synthetic construct
PATSGPTE

SEQ ID NO: 73 - protein, 5 aa, synthetic construct
SASPE

SEQ ID NO: 74 - protein, 8 aa, synthetic construct
PATSGSTE

SEQ ID NO: 75 - protein, 9 aa, synthetic construct
GSAPGTSAE

SEQ ID NO: 76 - protein, 7 aa, synthetic construct
SATSGSE

SEQ ID NO: 77 - protein, 9 aa, synthetic construct
SGPGSTPAE

SEQ ID NO: 78 - protein, 11 aa, synthetic construct
SGPGSGPGTSE

SEQ ID NO: 79 - protein, 12 aa, synthetic construct
SGPGTSPSATPE

SEQ ID NO: 80 - skipped

SEQ ID NO: 81 - protein, 30 aa, synthetic construct
SESATPESGPGTSPGATPESGPGTSESATP

SEQ ID NO: 82 - protein, 30 aa, synthetic construct
GSGEGSEGEGGGEGSEGEGSGEGGEGEGSG

SEQ ID NO: 83 - protein, 32 aa, synthetic construct
TGSGEGSEGEGGGEGSEGEGSGEGGEGEGSGT

SEQ ID NO: 84 - protein, 30 aa, synthetic construct
GATPPETGAETESPGETTGGSAESEPPGEG

SEQ ID NO: 85 - protein, 30 aa, synthetic construct
GSAAPTAGTTPSASPAPPTGGSSAAGSPST

SEQ ID NO: 86 - protein, 6 aa, synthetic construct
SGGGGS

SEQ ID NO: 87 - protein, 5 aa, synthetic construct
GGGGS

SEQ ID NO: 88 - protein, 6 aa, synthetic construct
GGSGGS

SEQ ID NO: 89 - protein, 5 aa, synthetic construct
STEPS

SEQ ID NO: 90 - protein, 10 aa, synthetic construct
SATPESGPGT

SEQ ID NO: 91 - protein, 10 aa, synthetic construct
ATSGSETPGT

SEQ ID NO: 92 - protein, 10 aa, synthetic construct
GTAEAASASG

SEQ ID NO: 93 - protein, 13 aa, synthetic construct
STEPSEGSAPGTS

SEQ ID NO: 94 - protein, 6 aa, synthetic construct
SGPGTS

SEQ ID NO: 95 - protein, 7 aa, synthetic construct
GTSTEPS

SEQ ID NO: 96 - protein, 10 aa, synthetic construct
GTSESATPES

SEQ ID NO: 97 - protein, 10 aa, synthetic construct
GTATPESGPG

SEQ ID NO: 98-100 - skipped (3 entries)

SEQ ID NO: 101 - protein, 109 aa, synthetic construct
ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVL

SEQ ID NO: 102 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 103 - protein, 109 aa, synthetic construct
ELVVTQEPSLTVSPGGTVTLTCRSSNGEVTTSNYANWVQQKPGQAPRGLIGGTIKRAPGTPARFSGSLLGGKAALTLSGVQPEDEAVYYCALWYPNLWVFGGGTKLTVL

SEQ ID NO: 104 - protein, 109 aa, synthetic construct
ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVL

SEQ ID NO: 105 - protein, 125 aa, synthetic construct
EVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 106 - protein, 109 aa, synthetic construct
ELVVTQEPSLTVSPGGTVTLTCRSSNGAVTSSNYANWVQQKPGQAPRGLIGGTNKRAPGTPARFSGSLLGGSAALTLSGVQPEDEAVYYCALWYPNLWVFGGGTKLTVL

SEQ ID NO: 107 - protein, 109 aa, synthetic construct
ELVVTQEPSLTVSPGGTVTLTCRSSNGAVTSSNYANWVQQKPGQAPRGLIGGTNKRAPGTPARFSGSSLGGSAALTLSGVQPEDEAVYYCALWYPNLWVFGGGTKLTVL

SEQ ID NO: 108 - protein, 109 aa, synthetic construct
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVL

SEQ ID NO: 109 - protein, 125 aa, synthetic construct
EVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 110 - protein, 109 aa, synthetic construct
ELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVL

SEQ ID NO: 111 - protein, 125 aa, synthetic construct
EVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 112 - protein, 15 aa, synthetic construct
GGGGSGGGGSGGGGS

SEQ ID NO: 113 - protein, 18 aa, synthetic construct
GEGTSTGSGGSGGSGGAD

SEQ ID NO: 114 - protein, 18 aa, synthetic construct
VEGGSGGSGGSGGSGGVD

SEQ ID NO: 115 - protein, 29 aa, synthetic construct
RTSGPGDGGKGGPGKGPGGEGTKGTGPGG

SEQ ID NO: 116 - protein, 30 aa, synthetic construct; identical to SEQ ID NO: 82

SEQ ID NO: 117 - protein, 32 aa, synthetic construct; identical to SEQ ID NO: 83

SEQ ID NO: 118 - protein, 30 aa, synthetic construct; identical to SEQ ID NO: 84

SEQ ID NO: 119 - protein, 30 aa, synthetic construct; identical to SEQ ID NO: 85

SEQ ID NO: 120 - protein, 30 aa, synthetic construct
GEGGESGGSEGEGSGEGEGGSGGEGESEGG

SEQ ID NO: 121 - protein, 30 aa, synthetic construct
STETSPSTPTESPEAGSGSGSPESPSGTEA

SEQ ID NO: 122 - protein, 30 aa, synthetic construct
PTGTTGEPSGEGSEPEGSAPTSSTSEATPS

SEQ ID NO: 123 - protein, 30 aa, synthetic construct
SESESEGEAPTGPGASTTPEPSESPTPETS

SEQ ID NO: 124 - protein, 30 aa, synthetic construct
PEGGESGEGTGPGTGGEPEGEGGPGGEGGT

SEQ ID NO: 125 - protein, 9 aa, synthetic construct
GGGGSGGGS

SEQ ID NO: 126 - protein, 125 aa, synthetic construct
EVQLVESGGGIVQPGGSLRLSCAASGFTFSTYAMNWVRQAPGKGLEWVGRIRTKRNDYATYYADSVKGRFTISRDDSKNTLYLQMNSLKTEDTAVYYCVRHENFGNSYVSWFAHWGQGTLVTVSS

SEQ ID NO: 127 - protein, 109 aa, synthetic construct
ELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVL

SEQ ID NO: 128 - protein, 264 aa, synthetic construct
ELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNDYATYYADSVKGRFTISRDDSKNTLYLQMNSLKTEDTAVYYCVRHENFGNSYVSWFAHWGQGTLVTVSS

SEQ ID NO: 129-178 - skipped (50 entries)

SEQ ID NO: 179 - protein, 12 aa, synthetic construct
GSETPSGPSETA

SEQ ID NO: 180 - protein, 12 aa, synthetic construct
GPSETSTSEPGA

SEQ ID NO: 181 - protein, 12 aa, synthetic construct
GSPSEPTEGTSA

SEQ ID NO: 182 - protein, 12 aa, synthetic construct
GESPGGSSGSES

SEQ ID NO: 183 - protein, 12 aa, synthetic construct
GSEGSSGPGESS

SEQ ID NO: 184 - protein, 12 aa, synthetic construct
GSSESGSSEGGP

SEQ ID NO: 185 - protein, 12 aa, synthetic construct
GSGGEPSESGSS

SEQ ID NO: 186 - protein, 12 aa, synthetic construct
GSPAGSPTSTEE

SEQ ID NO: 187 - protein, 12 aa, synthetic construct
GSEPATSGSETP

SEQ ID NO: 188 - protein, 12 aa, synthetic construct
GTSESATPESGP

SEQ ID NO: 189 - protein, 12 aa, synthetic construct
GTSTEPSEGSAP

SEQ ID NO: 190 - protein, 12 aa, synthetic construct
GSTSESPSGTAP

SEQ ID NO: 191 - protein, 12 aa, synthetic construct
GTSTPESGSASP

SEQ ID NO: 192 - protein, 12 aa, synthetic construct
GTSPSGESSTAP

SEQ ID NO: 193 - protein, 12 aa, synthetic construct
GSTSSTAESPGP

SEQ ID NO: 194 - protein, 12 aa, synthetic construct
GTPGSGTASSSP

SEQ ID NO: 195 - protein, 12 aa, synthetic construct
GSSTPSGATGSP

SEQ ID NO: 196 - protein, 12 aa, synthetic construct
GSSPSASTGTGP

SEQ ID NO: 197 - protein, 12 aa, synthetic construct
GASPGTSSTGSP

SEQ ID NO: 198 - protein, 12 aa, synthetic construct
GEPAGSPTSTSE

SEQ ID NO: 199 - protein, 12 aa, synthetic construct
GTGEPSSTPASE

SEQ ID NO: 200 - protein, 12 aa, synthetic construct
GSGPSTESAPTE

SEQ ID NO: 201 - protein, 264 aa, synthetic construct
ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 202 - protein, 264 aa, synthetic construct
ELVVTQEPSLTVSPGGTVTLTCRSSNGEVTTSNYANWVQQKPGQAPRGLIGGTIKRAPGTPARFSGSLLGGKAALTLSGVQPEDEAVYYCALWYPNLWVFGGGTKLTVLGATPPETGAETESPGETTGGSAESEPPGEGEVQLLESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 203 - protein, 264 aa, synthetic construct
ELVVTQEPSLTVSPGGTVTLTCRSSNGAVTSSNYANWVQQKPGQAPRGLIGGTNKRAPGTPARFSGSSLGGKAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 204 - protein, 264 aa, synthetic construct
ELVVTQEPSLTVSPGGTVTLTCRSSNGAVTSSNYANWVQQKPGQAPRGLIGGTNKRAPGTPARFSGSLLGGSAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 205 - protein, 264 aa, synthetic construct
ELVVTQEPSLTVSPGGTVTLTCRSSNGAVTSSNYANWVQQKPGQAPRGLIGGTNKRAPGTPARFSGSSLGGSAALTLSGVQPEDEAVYYCALWYPNLWVFGGGTKLTVLGATPPETGAETESPGETTGGSAESEPPGEGEVQLQESGGGIVQPGGSLKLSCAASGFTFNTYAMNWVRQAPGKGLEWVARIRSKYNNYATYYADSVKDRFTISRDDSKNTVYLQMNNLKTEDTAVYYCVRHENFGNSYVSWFAHWGQGTLVTVSS

SEQ ID NO: 206 - protein, 264 aa, synthetic construct
ELVVTQEPSLTVSPGGTVTLTCRSSTGAVTTSNYANWVQQKPGQAPRGLIGGTNKRAPGTPARFSGSLLGGKAALTLSGVQPEDEAEYYCALWYSNLWVFGGGTKLTVLGATPPETGAETESPGETTGGSAESEPPGEGEVQLLESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 207 - protein, 264 aa, synthetic construct
ELVVTQEPSLTVSPGGTVTLTCRSSTGAVTTSNYANWVQQKPGQAPRGLIGGTNKRAPGTPARFSGSSLGGSAALTLSGVQPEDEAEYYCALWYSNLWVFGGGTKLTVLGATPPETGAETESPGETTGGSAESEPPGEGEVQLQESGGGLVQPGGSLKLSCAASGFTFNTYAMNWVRQAPGKGLEWVARIRSKYNNYATYYADSVKDRFTISRDDSKNTAYLQMNNLKTEDTAVYYCVRHGNFGNSYVSWFAYWGQGTLVTVSS

SEQ ID NO: 208 - protein, 256 aa, synthetic construct
QSVLTQPPSASGTPGQRVTISCSGSSSNIGSNYVYWYQQLPGTAPKLLIYRNNQRPSGVPDRFSGSKSGTSASLAISGLRSEDEADYYCAAWDDSLSGLWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 209 - protein, 255 aa, synthetic construct
QAGLTQPPSASGTPGQRVTLSCSGSYSNIGTYYVYWYQQLPGTAPKLLIYSNDQRLSGVPDRFSGSKSGTSASLAISGLQSEDEAAYYCAAWDDSLNGWAFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 210 - protein, 255 aa, synthetic construct
QPGLTQPPSASGTPGQRVTLSCSGRSSNIGSYYVYWYQHLPGMAPKLLIYRNSRRPSGVPDRFSGSKSGTSASLVISGLQSDDEADYYCAAWDDSLKSWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 211 - protein, 255 aa, synthetic construct
QSVLTQPPSASGTPGQRVTISCSGSSSNIGTNYVYWYQQFPGTAPKLLIYSNNQRPSGVPDRFSGSKSGTSGSLAISGLQSEDEADYSCAAWDDSLNGWVFGGGTKLTVLGATPPETGAETESPGETTGGSAESEPPGEGQVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 212 - protein, 255 aa, synthetic construct
QPGLTQPPSASGTPGQRVTISCSGSSSNIGSNYVYWYQQLPGTAPKLLIYRNNQRPSGVPDRLSGSKSGTSASLAISGLRSEDEADYYCAAWDDSLSGWVFGGGTKLTVLGATPPETGAETESPGETTGGSAESEPPGEGQVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 213 - protein, 256 aa, synthetic construct
QAVLTQPPSASGTPGQRVTISCSGSSSNIGSYYVYWYQQVPGAAPKLLMRLNNQRPSGVPDRFSGAKSGTSASLVISGLRSEDEADYYCAAWDDSLSGQWVFGGGTKLTVLGATPPETGAETESPGETTGGSAESEPPGEGQVQLQQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 214 - protein, 255 aa, synthetic construct
QAGLTQPPSASGTPGQRVTISCSGSSSNIGSNYVYWYQQLPGTAPKLLIYRNNQRPSGVPDRFSGSKSGTSASLAISGLRSEDEADYYCATWDASLSGWVFGGGTKLTVLGATPPETGAETESPGETTGGSAESEPPGEGEVQLVQWGGGLVKPGGSLRLSCAASGFTFSSYSMNWVRQAPGKGLEWVSRINSDGSSTNYADSVKGRFTISRDNAKNTLYLQMNSLRAEDTAVYYCARELRWGNWGQGTLVTVSS

SEQ ID NO: 215 - protein, 264 aa, synthetic construct
ELVVTQEPSLTVSPGGTVTLTCRSSNGAVTSSNYANWVQQKPGQAPRGLIGGTNKRAPGTPARFSGSLLGGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS

SEQ ID NO: 216-300 - skipped (85 entries)

SEQ ID NO: 301 - protein, 119 aa, synthetic construct [sequence omitted]

SEQ ID NO: 302 - protein, 122 aa, synthetic construct [sequence omitted]

SEQ ID NO: 303 - protein, 119 aa, synthetic construct
QVQLVQSGGGVVQPGRSLRLSCKASGYTFTSYTMHWVRQAPGKGLEWIGYINPSSGYTKYNQKFKDRFTISADKSKSTAFLQMDSLRPEDTGVYFCARWQDYDVYFDYWGQGTPVTVSS

SEQ ID NO: 304 - protein, 119 aa, synthetic construct [sequence omitted]

SEQ ID NO: 305 - protein, 119 aa, synthetic construct
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSS

SEQ ID NO: 306 - protein, 119 aa, synthetic construct
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSS

SEQ ID NO: 307 - protein, 125 aa, synthetic construct
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSS

SEQ ID NO: 308 - protein, 125 aa, synthetic construct
EVQLVESGGGLVQPGGSLRLSCAASGFTFNTYAMNWVRQAPGKGLEWVGRIRSKYNNYATYYADSVKGRFTISRDDSKNTLYLQMNSLRAEDTAVYYCVRHGNFGNSYVSWFAYWGQGTLVTVSS

SEQ ID NO: 309 - protein, 125 aa, synthetic construct; identical to SEQ ID NO: 109

SEQ ID NO: 310 - protein, 125 aa, synthetic construct
EVKLLESGGGLVQPKGSLKLSCAASGFTFNTYAMNWVRQAPGKGLEWVARIRSKYNNYATYYADSVKDRFTISRDDSQSILYLQMNNLKTEDTAMYYCVRHGNFGNSYVSWFAYWGQGTLVTVSS

SEQ ID NO: 311 - protein, 125 aa, synthetic construct
EVQLVESGGGIVQPGGSLRLSCAASGFTFSTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS

SEQ ID NO: 312-350 - skipped (39 entries)

SEQ ID NO: 351 - protein, 107 aa, synthetic construct
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITR

SEQ ID NO: 352 - protein, 107 aa, synthetic construct [sequence omitted]

SEQ ID NO: 353 - protein, 107 aa, synthetic construct
DIQMTQSPSSLSASVGDRVTMTCRASSSVSYMHWYQQTPGKAPKPWIYATSNLASGVPSRFSGSGSGTDYTLTISSLQPEDIATYYCQQWSSNPPTFGQGTKLQITR

SEQ ID NO: 354 - protein, 107 aa, synthetic construct
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINR

SEQ ID NO: 355 - protein, 106 aa, synthetic construct
DIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 356 - protein, 106 aa, synthetic construct
DIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 357 - protein, 109 aa, synthetic construct
QTVVTQEPSLTVSPGGTVTLTCGSSTGAVTSGYYPNWVQQKPGQAPRGLIGGTKFLAPGTPARFSGSLLGGKAALTLSGVQPEDEAEYYCALWYSNRWVFGGGTKLTVL

SEQ ID NO: 358 - protein, 109 aa, synthetic construct
QAVVTQEPSLTVSPGGTVTLTCGSSTGAVTTSNYANWVQQKPGQAPRGLIGGTNKRAPGVPARFSGSLLGGKAALTLSGAQPEDEAEYYCALWYSNLWVFGGGTKLTVL

SEQ ID NO: 359 - protein, 109 aa, synthetic construct; identical to SEQ ID NO: 108

SEQ ID NO: 360 - protein, 109 aa, synthetic construct
QAVVTQESALTTSPGETVTLTCRSSTGAVTTSNYANWVQEKPDHLFTGLIGGTNKRAPGVPARFSGSLIGDKAALTITGAQTEDEAIYFCALWYSNLWVFGGGTKLTVL

SEQ ID NO: 361 - protein, 109 aa, synthetic construct; identical to SEQ ID NO: 101

SEQ ID NO: 362-399 - skipped (38 entries)

SEQ ID NO: 400 - protein, 25 aa, synthetic construct
EVQLVESGGGIVQPGGSLRLSCAAS

SEQ ID NO: 401 - protein, 14 aa, synthetic construct
WVRQAPGKGLEWVG

SEQ ID NO: 402 - protein, 32 aa, synthetic construct
RFTISRDDSKNTVYLQMNSLKTEDTAVYYCVR

SEQ ID NO: 403 - protein, 32 aa, synthetic construct
GTPARFSGSLLEGKAALTLSGVQPEDEAVYYC

SEQ ID NO: 404 - protein, 32 aa, synthetic construct
RFTISRDDSKNTLYLQMNSLKTEDTAVYYCVR

SEQ ID NO: 405-448 - skipped (44 entries)

SEQ ID NO: 449 - protein, 256 aa, synthetic construct
DIQMTQSPSSLSASVGDRVTITCQASQDISNYLNWYQQKPGKAPKLLIYDASNLETGVPSRFSGSGSGTDFTFTISSLQPEDIATYYCQHFDHLPLAFGQGTKVEIKSESATPESGPGTSPGATPESGPGTSESATPQVQLQESGPGLVKPSETLSLTCTVSGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSS

SEQ ID NO: 450 - protein, 119 aa, synthetic construct [sequence omitted]

SEQ ID NO: 451 - protein, 107 aa, synthetic construct [sequence omitted]

SEQ ID NO: 452 - protein, 119 aa, synthetic construct
QVQLVQSGAEVKKPGASVKVSCKASGGSVSSGDYYWTWVRQAPGQGLEWMGHIYYSGNTNYNPSLKSRVTSTRDTSISTAYMELSRLRSDDTVVYYCARDRVTGAFDIWGQGTLVTVSS

SEQ ID NO: 453 - protein, 107 aa, synthetic construct
DIQMTQSPSSLSASVGDRVTITCQASQDISNYLNWYQQKPGKAPKLLIYDASNLETGVPSRFSGSGSGTDFTFTISSLQPEDIATYYCQHFDHLPLAFGQGTKVEIK

SEQ ID NO: 454 - protein, 119 aa, synthetic construct
QVQLVQSGAEVKKPGASVKVSCKASGGSVSSGDYYWTWVRQAPGQGLEWMGHIYYSGNTNYNPSLKSRVTMTRDTSTSTVYMELSSLRSEDTAVYYCARDRVTGAFDIWGQGTLVTVSS

SEQ ID NO: 455 - protein, 107 aa, synthetic construct; identical to SEQ ID NO: 453

SEQ ID NO: 456 - protein, 119 aa, synthetic construct
QVQLVQSGAEVKKPGSSVKVSCKASGGSVSSGDYYWTWVRQAPGQGLEWMGHIYYSGNTNYNPSLKSRVTITADESTSTAYMELSSLRSEDTAVYYCARDRVTGAFDIWGQGTLVTVSS

SEQ ID NO: 457 - protein, 107 aa, synthetic construct; identical to SEQ ID NO: 453

SEQ ID NO: 458 - protein, 119 aa, synthetic construct
EVQLLESGGGLVQPGGSLRLSCAASGGSVSSGDYYWTWVRQAPGKGLEWVSHIYYSGNTNYNPSLKSRFTISRDNSKNTLYLQMNSLRAEDTAVYYCAKDRVTGAFDIWGQGTLVTVSS

SEQ ID NO: 459 - protein, 107 aa, synthetic construct; identical to SEQ ID NO: 453

SEQ ID NO: 460 - protein, 119 aa, synthetic construct
QVQLVESGGGVVQPGRSLRLSCAASGGSVSSGDYYWTWVRQAPGKGLEWVAHIYYSGNTNYNPSLKSRFTISRDNSKNTLYLQMNSLRAEDTAVYYCARDRVTGAFDIWGQGTLVTVSS

SEQ ID NO: 461 - protein, 107 aa, synthetic construct; identical to SEQ ID NO: 453

SEQ ID NO: 462 - protein, 119 aa, synthetic construct
EVQLVESGGGLVQPGGSLRLSCAASGGSVSSGDYYWTWVRQAPGKGLEWVAHIYYSGNTNYNPSLKSRFTISRDNAKNSLYLQMNSLRAEDTAVYYCARDRVTGAFDIWGQGTLVTVSS

SEQ ID NO: 463 - protein, 107 aa, synthetic construct; identical to SEQ ID NO: 453

SEQ ID NO: 464 - protein, 119 aa, synthetic construct
EVQLVESGGGLVQPGGSLRLSCAASGGSVSSGDYYWTWVRQAPGKGLEWVSHIYYSGNTNYNPSLKSRFTISRDNSKNTLYLQMNSLRAEDTAVYYCARDRVTGAFDIWGQGTLVTVSS

SEQ ID NO: 465 - protein, 107 aa, synthetic construct; identical to SEQ ID NO: 453

SEQ ID NO: 466 - protein, 119 aa, synthetic construct
QVQLQQWGAGLLKPSETLSLTCAVYGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSS

SEQ ID NO: 467 - protein, 107 aa, synthetic construct; identical to SEQ ID NO: 453

SEQ ID NO: 468 - protein, 119 aa, synthetic construct
QVQLQESGPGLVKPSETLSLTCTVSGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSS

SEQ ID NO: 469 - protein, 107 aa, synthetic construct; identical to SEQ ID NO: 453

SEQ ID NO: 470 - protein, 119 aa, synthetic construct
EVQLVQSGAEVKKPGESLKISCKGSGGSVSSGDYYWTWVRQMPGKGLEWMGHIYYSGNTNYNPSLKSQVTISADKSISTAYLQWSSLKASDTAMYYCARDRVTGAFDIWGQGTLVTVSS

SEQ ID NO: 471 - protein, 107 aa, synthetic construct; identical to SEQ ID NO: 453

SEQ ID NO: 472 - protein, 119 aa, synthetic construct
QVQLVQSGSELKKPGASVKVSCKASGGSVSSGDYYWTWVRQAPGQGLEWMGHIYYSGNTNYNPSLKSRFVFSLDTSVSTAYLQICSLKAEDTAVYYCARDRVTGAFDIWGQGTLVTVSS

SEQ ID NO: 473 - protein, 107 aa, synthetic construct; identical to SEQ ID NO: 453

SEQ ID NO: 474 - protein, 119 aa, synthetic construct
QVQLVQSGVEVKKPGASVKVSCKASGGSVSSGDYYWTWVRQAPGQGLEWMGHIYYSGNTNYNPSLKSRVTLTTDSSTTTAYMELKSLQFDDTAVYYCARDRVTGAFDIWGQGTLVTVSS

SEQ ID NO: 475 - protein, 107 aa, synthetic construct; identical to SEQ ID NO: 453

SEQ ID NO: 476 - protein, 119 aa, synthetic construct; identical to SEQ ID NO: 452

SEQ ID NO: 477 - protein, 107 aa, synthetic construct
DIQMTQSPSSLSASVGDRVTITCQASQDISNYLNWYQQKPGKAPKLLIYDASNLETGVPSRFSGSGSGTDFTLTISSLQPEDFATYYCQHFDHLPLAFGQGTKVEIK

SEQ ID NO: 478 - protein, 119 aa, synthetic construct; identical to SEQ ID NO: 454

SEQ ID NO: 479 - protein, 107 aa, synthetic construct; identical to SEQ ID NO: 477

SEQ ID NO: 480 - protein, 119 aa, synthetic construct; identical to SEQ ID NO: 456

SEQ ID NO: 481 - protein, 107 aa, synthetic construct; identical to SEQ ID NO: 477

SEQ ID NO: 482 - protein, 119 aa, synthetic construct; identical to SEQ ID NO: 458

SEQ ID NO: 483 - protein, 107 aa, synthetic construct; identical to SEQ ID NO: 477

SEQ ID NO: 484 - protein, 119 aa, synthetic construct; identical to SEQ ID NO: 460

SEQ ID NO: 485 - protein, 107 aa, synthetic construct; identical to SEQ ID NO: 477

SEQ ID NO: 486 - protein, 119 aa, synthetic construct; identical to SEQ ID NO: 462

SEQ ID NO: 487 - protein, 107 aa, synthetic construct; identical to SEQ ID NO: 477

SEQ ID NO: 488 - protein, 119 aa, synthetic construct; identical to SEQ ID NO: 464

SEQ ID NO: 489 - protein, 107 aa, synthetic construct; identical to SEQ ID NO: 477

SEQ ID NO: 490 - protein, 119 aa, synthetic construct; identical to SEQ ID NO: 466

SEQ ID NO: 491 - protein, 107 aa, synthetic construct; identical to SEQ ID NO: 477

SEQ ID NO: 492 - protein, 119 aa, synthetic construct; identical to SEQ ID NO: 468

SEQ ID NO: 493 - protein, 107 aa, synthetic construct; identical to SEQ ID NO: 477

SEQ ID NO: 494 - protein, 119 aa, synthetic construct; identical to SEQ ID NO: 470

SEQ ID NO: 495 - protein, 107 aa, synthetic construct; identical to SEQ ID NO: 477

SEQ ID NO: 496 - protein, 119 aa, synthetic construct; identical to SEQ ID NO: 472

SEQ ID NO: 497 - protein, 107 aa, synthetic construct; identical to SEQ ID NO: 477

SEQ ID NO: 498 - protein, 119 aa, synthetic construct; identical to SEQ ID NO: 474

SEQ ID NO: 499 - protein, 107 aa, synthetic construct; identical to SEQ ID NO: 477

SEQ ID NO: 500 - protein, 119 aa, synthetic construct; identical to SEQ ID NO: 452

SEQ ID NO: 501 - protein, 107 aa, synthetic construct
EIVLTQSPGTLSLSPGERATLSCQASQDISNYLNWYQQKPGQAPRLLIYDASNLETGIPDRFSGSGSGTDFTLTISRLEPEDFAVYYCQHFDHLPLAFGQGTKVEIK

SEQ ID NO: 502 - protein, 119 aa, synthetic construct; identical to SEQ ID NO: 454

SEQ ID NO: 503 - protein, 107 aa, synthetic construct; identical to SEQ ID NO: 501

SEQ ID NO: 504 - protein, 119 aa, synthetic construct; identical to SEQ ID NO: 456

SEQ ID NO: 505 - protein, 107 aa, synthetic construct; identical to SEQ ID NO: 501

SEQ ID NO: 506 - protein, 119 aa, synthetic construct; identical to SEQ ID NO: 458

SEQ ID NO: 507 - protein, 107 aa, synthetic construct; identical to SEQ ID NO: 501

SEQ ID NO: 508 - protein, 119 aa, synthetic construct; identical to SEQ ID NO: 460

SEQ ID NO: 509 - protein, 107 aa, synthetic construct; identical to SEQ ID NO: 501

SEQ ID NO: 510 - protein, 119 aa, synthetic construct; identical to SEQ ID NO: 462

SEQ ID NO: 511 - protein, 107 aa, synthetic construct; identical to SEQ ID NO: 501

SEQ ID NO: 512 - protein, 119 aa, synthetic construct; identical to SEQ ID NO: 464

SEQ ID NO: 513 - protein, 107 aa, synthetic construct; identical to SEQ ID NO: 501

SEQ ID NO: 514 - protein, 119 aa, synthetic construct; identical to SEQ ID NO: 466

SEQ ID NO: 515 - protein, 107 aa, synthetic construct; identical to SEQ ID NO: 501

SEQ ID NO: 516 - protein, 119 aa, synthetic construct; identical to SEQ ID NO: 468

SEQ ID NO: 517 - protein, 107 aa, synthetic construct; identical to SEQ ID NO: 501

SEQ ID NO: 518 - protein, 119 aa, synthetic construct; identical to SEQ ID NO: 470

SEQ ID NO: 519 - protein, 107 aa, synthetic construct; identical to SEQ ID NO: 501

SEQ ID NO: 520 - protein, 119 aa, synthetic construct; identical to SEQ ID NO: 472

SEQ ID NO: 521 - protein, 107 aa, synthetic construct; identical to SEQ ID NO: 501

SEQ ID NO: 522 - protein, 119 aa, synthetic construct; identical to SEQ ID NO: 474

SEQ ID NO: 523 - protein, 107 aa, synthetic construct; identical to SEQ ID NO: 501

SEQ ID NO: 524 - protein, 119 aa, synthetic construct; identical to SEQ ID NO: 452

SEQ ID NO: 525 - protein, 107 aa, synthetic construct
EIVLTQSPATLSLSPGERATLSCQASQDISNYLNWYQQKPGQAPRLLIYDASNLETGIPARFSGSGSGTDFTLTISSLEPEDFAVYYCQHFDHLPLAFGQGTKVEIK

SEQ ID NO: 526 - protein, 119 aa, synthetic construct; identical to SEQ ID NO: 454

SEQ ID NO: 527 - protein, 107 aa, synthetic construct; identical to SEQ ID NO: 525

SEQ ID NO: 528 - protein, 119 aa, synthetic construct; identical to SEQ ID NO: 456

SEQ ID NO: 529 - protein, 107 aa, synthetic construct; identical to SEQ ID NO: 525

SEQ ID NO: 530 - protein, 119 aa, synthetic construct; identical to SEQ ID NO: 458

SEQ ID NO: 531 - protein, 107 aa, synthetic construct; identical to SEQ ID NO: 525

SEQ ID NO: 532 - protein, 119 aa, synthetic construct; identical to SEQ ID NO: 460

SEQ ID NO: 533 - protein, 107 aa, synthetic construct; identical to SEQ ID NO: 525

SEQ ID NO: 534 - protein, 119 aa, synthetic construct; identical to SEQ ID NO: 462

SEQ ID NO: 535 - protein, 107 aa, synthetic construct; identical to SEQ ID NO: 525

SEQ ID NO: 536 - protein, 119 aa, synthetic construct; identical to SEQ ID NO: 464

SEQ ID NO: 537 - protein, 107 aa, synthetic construct; identical to SEQ ID NO: 525

SEQ ID NO: 538 - protein, 119 aa, synthetic construct; identical to SEQ ID NO: 466

SEQ ID NO: 539 - protein, 107 aa, synthetic construct; identical to SEQ ID NO: 525

SEQ ID NO: 540 - protein, 119 aa, synthetic construct; identical to SEQ ID NO: 468

SEQ ID NO: 541 - protein, 107 aa, synthetic construct; identical to SEQ ID NO: 525

SEQ ID NO: 542 - protein, 119 aa, synthetic construct; identical to SEQ ID NO: 470

SEQ ID NO: 543 - protein, 107 aa, synthetic construct; identical to SEQ ID NO: 525

SEQ ID NO: 544 - protein, 119 aa, synthetic construct; identical to SEQ ID NO: 472

SEQ ID NO: 545 - protein, 107 aa, synthetic construct; identical to SEQ ID NO: 525

SEQ ID NO: 546 - protein, 119 aa, synthetic construct; identical to SEQ ID NO: 474

SEQ ID NO: 547 - protein, 107 aa, synthetic construct; identical to SEQ ID NO: 525

SEQ ID NO: 548 - protein, 119 aa, synthetic construct
QVQLVESGGGVVQPGRSLRLSCAASGGSVSSGDYYWTWVRQAPGKGLEWVAHIYYSGNTNYNPSLKSRLTISRDNSKNTLYLQMNSLRAEDTAVYYCVRDRVTGAFDIWGQGTLVTVSS

SEQ ID NO: 549 - protein, 107 aa, synthetic construct
DIQMTQSPSSLSASVGDRVTITCQASQDISNYLNWYQQKPGKAPKLLIYDASNLETGVPSRFSGSGSGTDFTLTISSLQPEDFATYFCQHFDHLPLAFGQGTKVEIK

SEQ ID NO: 550 - protein, 119 aa, synthetic construct
EVQLVESGGGLVQPGGSLRLSCAASGGSVSSGDYYWTWVRQAPGKGLEWVAHIYYSGNTNYNPSLKSRLTISRDNAKNSLYLQMNSLRAEDTAVYYCVRDRVTGAFDIWGQGTLVTVSS

SEQ ID NO: 551 - protein, 107 aa, synthetic construct; identical to SEQ ID NO: 549

SEQ ID NO: 552 - protein, 119 aa, synthetic construct
QVQLVQSGAEVKKPGSSVKVSCKASGGSVSSGDYYWTWVRQAPGQGLEWMGHIYYSGNTNYNPSLKSRLTITADESTSTAYMELSSLRSEDTAVYYCVRDRVTGAFDIWGQGTLVTVSS

SEQ ID NO: 553 - protein, 107 aa, synthetic construct; identical to SEQ ID NO: 549

SEQ ID NO: 554 - protein, 119 aa, synthetic construct; identical to SEQ ID NO: 548

SEQ ID NO: 555 - protein, 107 aa, synthetic construct
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGQGTKVEIK

SEQ ID NO: 556 - protein, 119 aa, synthetic construct; identical to SEQ ID NO: 550

SEQ ID NO: 557 - protein, 107 aa, synthetic construct; identical to SEQ ID NO: 555

SEQ ID NO: 558 - protein, 119 aa, synthetic construct; identical to SEQ ID NO: 552

SEQ ID NO: 559 - protein, 107 aa, synthetic construct; identical to SEQ ID NO: 555

SEQ ID NO: 560 - protein, 119 aa, synthetic construct
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTLVTVSS

SEQ ID NO: 561 - protein, 107 aa, synthetic construct; identical to SEQ ID NO: 555

SEQ ID NO: 562 - protein, 12 aa, synthetic construct
GGSVSSGDYYWT

SEQ ID NO: 563 - protein, 16 aa, synthetic construct
HIYYSGNTNYNPSLKS

SEQ ID NO: 564 - protein, 9 aa, synthetic construct
DRVTGAFDI

SEQ ID NO: 565 - protein, 11 aa, synthetic construct
QASQDISNYLN

SEQ ID NO: 566 - protein, 7 aa, synthetic construct
DASNLET

SEQ ID NO: 567 - protein, 9 aa, synthetic construct
QHFDHLPLA

SEQ ID NO: 568-575 - skipped (8 entries)

SEQ ID NO: 576 - protein, 119 aa, synthetic construct
  VARIANT 7: note = X can be S or W
  VARIANT 9: note = X can be P or A
  VARIANT 12: note = X can be V or L
  VARIANT 23: note = X can be T or A
  VARIANT 25: note = X can be S or Y
QVQLQZXGXGLXKPSETLSLTCXVXGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSS

SEQ ID NO: 577 - protein, 107 aa, synthetic construct
  VARIANT 1: note = X can be D or E
  VARIANT 3: note = X can be Q or V
  VARIANT 4: note = X can be M or L
  VARIANT 9: note = X can be S, G, or A
  VARIANT 10: note = X can be S or T
  VARIANT 13: note = X can be L or A
  VARIANT 15: note = X can be P or V
  VARIANT 17: note = X can be D or E
  VARIANT 19: note = X can be V or A
  VARIANT 22: note = X can be T or S
  VARIANT 42: note = X can be K or Q
  VARIANT 45: note = X can be K or R
  VARIANT 58: note = X can be V or I
  VARIANT 60: note = X can be S, D, or A
  VARIANT 73: note = X can be F or L
  VARIANT 77: note = X can be S or R
  VARIANT 83: note = X can be I or F
  VARIANT 85: note = X can be T or V
XIXXTQSPXXLSXSXGXRXTJXCQASQDISNYLNWYQQKPGXAPXLLIYDASNLETGXPXRFSGSGSGTDFTXTISXLZPEDXAXYYCQHFDHLPLAFGQGTKVEIK

SEQ ID NO: 578-600 - skipped (23 entries)

SEQ ID NO: 601 - protein, 144 aa, synthetic construct
GSEPATSGSETPGTSESATPESGPGSEPATSGSETPGSPAGSPTSTEEGTSTEPSEGSAPGSEPATSGSETPGSEPATSGSETPGSEPATSGSETPGTSTEPSEGSAPGTSESATPESGPGSEPATSGSETPGTSTEPSEGSAP

SEQ ID NO: 602 - protein, 144 aa, synthetic construct
SPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPG

SEQ ID NO: 603 - protein, 144 aa, synthetic construct
TSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPG

SEQ ID NO: 604 - protein, 144 aa, synthetic construct; identical to SEQ ID NO: 603

SEQ ID NO: 605 - protein, 144 aa, synthetic construct
SPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPG

SEQ ID NO: 606 - protein, 144 aa, synthetic construct; identical to SEQ ID NO: 605

SEQ ID NO: 607 - protein, 144 aa, synthetic construct
TSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPG

SEQ ID NO: 608 - protein, 144 aa, synthetic construct; identical to SEQ ID NO: 607

SEQ ID NO: 609 - protein, 144 aa, synthetic construct
TSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEG

SEQ ID NO: 610 - protein, 144 aa, synthetic construct
TSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 611 - protein, 288 aa, synthetic construct
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 612 - protein, 288 aa, synthetic construct
GSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 613 - protein, 576 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 614 - protein, 625 aa, synthetic construct
MAEPAGSPTSTEEGTPGSGTASSSPGSSTPSGATGSPGASPGTSSTGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAP

SEQ ID NO: 615 - protein, 864 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 616 - protein, 865 aa, synthetic construct
GGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 617 - protein, 866 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 618 - protein, 1152 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 619 - protein, 144 aa, synthetic construct
STEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGS

SEQ ID NO: 620 - protein, 144 aa, synthetic construct
SEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPG

SEQ ID NO: 621 - protein, 180 aa, synthetic construct
TSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 622 - protein, 216 aa, synthetic construct
PESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 623 - protein, 252 aa, synthetic construct
ESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 624 - protein, 288 aa, synthetic construct
TPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 625 - protein, 324 aa, synthetic construct
PESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 626 - protein, 360 aa, synthetic construct
PESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 627 - protein, 360 aa, synthetic construct
PESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPS

SEQ ID NO: 628 - protein, 432 aa, synthetic construct
EGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 629 - protein, 468 aa, synthetic construct
EGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 630 - protein, 504 aa, synthetic construct
EGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 631 - protein, 540 aa, synthetic construct
TPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEP

SEQ ID NO: 632 - protein, 576 aa, synthetic construct
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESA

SEQ ID NO: 633 - protein, 612 aa, synthetic construct
GSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 634 - protein, 648 aa, synthetic construct
PESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 635 - protein, 684 aa, synthetic construct
EGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATS

SEQ ID NO: 636 - protein, 720 aa, synthetic construct
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTE

SEQ ID NO: 637 - protein, 756 aa, synthetic construct
TSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSES

SEQ ID NO: 638 - protein, 792 aa, synthetic construct
EGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPS

SEQ ID NO: 639 - protein, 828 aa, synthetic construct
PESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESAT

SEQ ID NO: 640 - protein, 869 aa, synthetic construct
GSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGR

SEQ ID NO: 641 - protein, 144 aa, synthetic construct
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTESASR

SEQ ID NO: 642 - protein, 288 aa, synthetic construct
SAGSPTGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 643 - protein, 432 aa, synthetic construct
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTESASR

SEQ ID NO: 644 - protein, 576 aa, synthetic construct
SAGSPTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPSASR

SEQ ID NO: 645 - protein, 864 aa, synthetic construct
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 646 - protein, 712 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEAHHH

SEQ ID NO: 647 - protein, 864 aa, synthetic construct
GSPGAGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTESASR

SEQ ID NO: 648 - protein, 288 aa, synthetic construct
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPG

SEQ ID NO: 649 - protein, 284 aa, synthetic construct
GTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSE

SEQ ID NO: 650 - protein, 292 aa, synthetic construct
SPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 651 - protein, 864 aa, synthetic construct
AGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 652 - protein, 867 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 653 - protein, 867 aa, synthetic construct
SPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPG

SEQ ID NO: 654 - protein, 868 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGAAEPEA

SEQ ID NO: 655 - protein, 144 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAP

SEQ ID NO: 656 - protein, 292 aa, synthetic construct; identical to SEQ ID NO: 650

SEQ ID NO: 657 - protein, 293 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPEGAAEPEA

SEQ ID NO: 658 - protein, 300 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGAAEPEA

SEQ ID NO: 659 - protein, 584 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGAAEPEA

SEQ ID NO: 660-699 - skipped (40 entries)

SEQ ID NO: 700 - protein, 109 aa, synthetic construct; identical to SEQ ID NO: 101

SEQ ID NO: 701 - protein, 125 aa, synthetic construct
EVQLLESGGGIVQPGGSLRLSCAASGFTFNTYAMNWVRQAPGKGLEWVGRIRSKRNNYATYYADSVKGRFTISRDDSKNTVYLQMNSLKTEDTAVYYCVRHENFGNSYVSWFAHWGQGTLVTVSS

SEQ ID NO: 702 - protein, 109 aa, synthetic construct; identical to SEQ ID NO: 101

SEQ ID NO: 703 - protein, 125 aa, synthetic construct
EVQLVESGGGIVQPGGSLRLSCAASGFTFNTYAMNWVRQAPGKGLEWVGRIRSKRNNYATYYADSVKGRFTISRDDSKNTVYLQMNSLKTEDTAVYYCVRHENFGNSYVSWFAHWGQGTLVTVSS

SEQ ID NO: 704 - protein, 109 aa, synthetic construct; identical to SEQ ID NO: 101

SEQ ID NO: 705 - protein, 125 aa, synthetic construct
EVQLLESGGGIVQPGGSLRLSCAASGFTFNTYAMNWVRQAPGKGLEWVGRIRSKTNNYATYYADSVKGRFTISRDDSKNTVYLQMNSLKTEDTAVYYCVRHENFGNSYVSWFAHWGQGTLVTVSS

SEQ ID NO: 706 - protein, 109 aa, synthetic construct; identical to SEQ ID NO: 101

SEQ ID NO: 707 - protein, 125 aa, synthetic construct
EVQLVESGGGIVQPGGSLRLSCAASGFTFNTYAMNWVRQAPGKGLEWVGRIRSKTNNYATYYADSVKGRFTISRDDSKNTVYLQMNSLKTEDTAVYYCVRHENFGNSYVSWFAHWGQGTLVTVSS

SEQ ID NO: 708 - protein, 109 aa, synthetic construct; identical to SEQ ID NO: 101

SEQ ID NO: 709 - protein, 125 aa, synthetic construct
EVQLLESGGGIVQPGGSLRLSCAASGFTFNTYAMNWVRQAPGKGLEWVGRIRSKYNDYATYYADSVKGRFTISRDDSKNTVYLQMNSLKTEDTAVYYCVRHENFGNSYVSWFAHWGQGTLVTVSS

SEQ ID NO: 710 - protein, 109 aa, synthetic construct; identical to SEQ ID NO: 101

SEQ ID NO: 711 - protein, 125 aa, synthetic construct
EVQLVESGGGIVQPGGSLRLSCAASGFTFNTYAMNWVRQAPGKGLEWVGRIRSKYNDYATYYADSVKGRFTISRDDSKNTVYLQMNSLKTEDTAVYYCVRHENFGNSYVSWFAHWGQGTLVTVSS

SEQ ID NO: 712 - protein, 109 aa, synthetic construct; identical to SEQ ID NO: 101

SEQ ID NO: 713 - protein, 125 aa, synthetic construct
EVQLLESGGGIVQPGGSLRLSCAASGFTFNTYAMNWVRQAPGKGLEWVGRIRSKYNNYATTYADSVKGRFTISRDDSKNTVYLQMNSLKTEDTAVYYCVRHENFGNSYVSWFAHWGQGTLVTVSS

SEQ ID NO: 714 - protein, 109 aa, synthetic construct; identical to SEQ ID NO: 101

SEQ ID NO: 715 - protein, 125 aa, synthetic construct
EVQLVESGGGIVQPGGSLRLSCAASGFTFNTYAMNWVRQAPGKGLEWVGRIRSKYNNYATTYADSVKGRFTISRDDSKNTVYLQMNSLKTEDTAVYYCVRHENFGNSYVSWFAHWGQGTLVTVSS

SEQ ID NO: 716 - protein, 109 aa, synthetic construct; identical to SEQ ID NO: 101

SEQ ID NO: 717 - protein, 125 aa, synthetic construct
EVQLVESGGGIVQPGGSLRLSCAASGFTFNTYAMNWVRQAPGKGLEWVGRIRSKRNNYATYYADSVKGRFTISRDDSKNTVYLQMNELKTEDTAVYYCVRHENFGNSYVSWFAHWGQGTLVTVSS

SEQ ID NO: 718 - protein, 109 aa, synthetic construct; identical to SEQ ID NO: 101

SEQ ID NO: 719 - protein, 125 aa, synthetic construct
EVQLVESGGGIVQPGGSLRLSCAASGFTFSTYAMNWVRQAPGKGLEWVGRIRSKRNNYATYYADSVKGRFTISRDDSKNTVYLQMNELKTEDTAVYYCVRHENFGNSYVSWFAHWGQGTLVTVSS

SEQ ID NO: 720 - protein, 109 aa, synthetic construct; identical to SEQ ID NO: 101

SEQ ID NO: 721 - protein, 125 aa, synthetic construct
EVQLVESGGGIVQPGGSLRLSCAASGFTFNTYAMNWVRQAPGKGLEWVGRIRSKTNNYATYYADSVKGRFTISRDDSKNTVYLQMNELKTEDTAVYYCVRHENFGNSYVSWFAHWGQGTLVTVSS

SEQ ID NO: 722 - protein, 109 aa, synthetic construct; identical to SEQ ID NO: 101

SEQ ID NO: 723 - protein, 125 aa, synthetic construct
EVQLVESGGGIVQPGGSLRLSCAASGFTFSTYAMNWVRQAPGKGLEWVGRIRSKTNNYATYYADSVKGRFTISRDDSKNTVYLQMNELKTEDTAVYYCVRHENFGNSYVSWFAHWGQGTLVTVSS

SEQ ID NO: 724 - protein, 109 aa, synthetic construct; identical to SEQ ID NO: 101

SEQ ID NO: 725 - protein, 125 aa, synthetic construct
EVQLVESGGGIVQPGGSLRLSCAASGFTFNTYAMNWVRQAPGKGLEWVGRIRSKYNDYATYYADSVKGRFTISRDDSKNTVYLQMNELKTEDTAVYYCVRHENFGNSYVSWFAHWGQGTLVTVSS

SEQ ID NO: 726 - protein, 109 aa, synthetic construct; identical to SEQ ID NO: 101

SEQ ID NO: 727 - protein, 125 aa, synthetic construct
EVQLVESGGGIVQPGGSLRLSCAASGFTFSTYAMNWVRQAPGKGLEWVGRIRSKYNDYATYYADSVKGRFTISRDDSKNTVYLQMNELKTEDTAVYYCVRHENFGNSYVSWFAHWGQGTLVTVSS

SEQ ID NO: 728 - protein, 109 aa, synthetic construct; identical to SEQ ID NO: 101

SEQ ID NO: 729 - protein, 125 aa, synthetic construct
EVQLVESGGGIVQPGGSLRLSCAASGFTFSTYAMNWVRQAPGKGLEWVGRIRSKRNNYATYYADSVKGRFTISRDDSKNTVYLQMNSLKTEDTAVYYCVRHENFGNSYVSWFAHWGQGTLVTVSS

SEQ ID NO: 730 - protein, 109 aa, synthetic construct; identical to SEQ ID NO: 101

SEQ ID NO: 731 - protein, 125 aa, synthetic construct
EVQLVESGGGIVQPGGSLRLSCAASGFTFSTYAMNWVRQAPGKGLEWVGRIRSKTNNYATYYADSVKGRFTISRDDSKNTVYLQMNSLKTEDTAVYYCVRHENFGNSYVSWFAHWGQGTLVTVSS

SEQ ID NO: 732 - protein, 109 aa, synthetic construct; identical to SEQ ID NO: 101

SEQ ID NO: 733 - protein, 125 aa, synthetic construct
EVQLVESGGGIVQPGGSLRLSCAASGFTFSTYAMNWVRQAPGKGLEWVGRIRSKYNDYATYYADSVKGRFTISRDDSKNTVYLQMNSLKTEDTAVYYCVRHENFGNSYVSWFAHWGQGTLVTVSS

SEQ ID NO: 734 - protein, 109 aa, synthetic construct; identical to SEQ ID NO: 101

SEQ ID NO: 735 - protein, 125 aa, synthetic construct
EVQLVESGGGIVQPGGSLRLSCAASGFTFSTYAMNWVRQAPGKGLEWVGRIRSKYNNYATTYADSVKGRFTISRDDSKNTVYLQMNSLKTEDTAVYYCVRHENFGNSYVSWFAHWGQGTLVTVSS

SEQ ID NO: 736 - protein, 109 aa, synthetic construct; identical to SEQ ID NO: 101

SEQ ID NO: 737 - protein, 125 aa, synthetic construct
EVQLVESGGGIVQPGGSLRLSCAASGFTFNTYAMNWVRQAPGKGLEWVGRIRTKRNNYATYYADSVKGRFTISRDDSKNTVYLQMNELKTEDTAVYYCVRHENFGNSYVSWFAHWGQGTLVTVSS

SEQ ID NO: 738 - protein, 109 aa, synthetic construct; identical to SEQ ID NO: 101

SEQ ID NO: 739 - protein, 125 aa, synthetic construct
EVQLVESGGGIVQPGGSLRLSCAASGFTFSTYAMNWVRQAPGKGLEWVGRIRTKRNNYATYYADSVKGRFTISRDDSKNTVYLQMNELKTEDTAVYYCVRHENFGNSYVSWFAHWGQGTLVTVSS

SEQ ID NO: 740 - protein, 109 aa, synthetic construct; identical to SEQ ID NO: 101

SEQ ID NO: 741 - protein, 125 aa, synthetic construct
EVQLVESGGGIVQPGGSLRLSCAASGFTFNTYAMNWVRQAPGKGLEWVGRIRTKTNNYATYYADSVKGRFTISRDDSKNTVYLQMNELKTEDTAVYYCVRHENFGNSYVSWFAHWGQGTLVTVSS

SEQ ID NO: 742 - protein, 109 aa, synthetic construct; identical to SEQ ID NO: 101

SEQ ID NO: 743 - protein, 125 aa, synthetic construct
EVQLVESGGGIVQPGGSLRLSCAASGFTFSTYAMNWVRQAPGKGLEWVGRIRTKTNNYATYYADSVKGRFTISRDDSKNTVYLQMNELKTEDTAVYYCVRHENFGNSYVSWFAHWGQGTLVTVSS

SEQ ID NO: 744 - protein, 109 aa, synthetic construct; identical to SEQ ID NO: 101

SEQ ID NO: 745 - protein, 125 aa, synthetic construct
EVQLVESGGGIVQPGGSLRLSCAASGFTFNTYAMNWVRQAPGKGLEWVGRIRTKYNDYATYYADSVKGRFTISRDDSKNTVYLQMNELKTEDTAVYYCVRHENFGNSYVSWFAHWGQGTLVTVSS

SEQ ID NO: 746 - protein, 109 aa, synthetic construct; identical to SEQ ID NO: 101

SEQ ID NO: 747 - protein, 125 aa, synthetic construct
EVQLVESGGGIVQPGGSLRLSCAASGFTFSTYAMNWVRQAPGKGLEWVGRIRTKYNDYATYYADSVKGRFTISRDDSKNTVYLQMNELKTEDTAVYYCVRHENFGNSYVSWFAHWGQGTLVTVSS

SEQ ID NO: 748 - protein, 109 aa, synthetic construct; identical to SEQ ID NO: 101

SEQ ID NO: 749 - protein, 125 aa, synthetic construct
EVQLVESGGGIVQPGGSLRLSCAASGFTFNTYAMNWVRQAPGKGLEWVGRIRTKYNNYATTYADSVKGRFTISRDDSKNTVYLQMNELKTEDTAVYYCVRHENFGNSYVSWFAHWGQGTLVTVSS

SEQ ID NO: 750 - protein, 109 aa, synthetic construct; identical to SEQ ID NO: 101

SEQ ID NO: 751 - protein, 125 aa, synthetic construct
EVQLVESGGGIVQPGGSLRLSCAASGFTFSTYAMNWVRQAPGKGLEWVGRIRTKYNNYATTYADSVKGRFTISRDDSKNTVYLQMNELKTEDTAVYYCVRHENFGNSYVSWFAHWGQGTLVTVSS

SEQ ID NO: 752 - protein, 109 aa, synthetic construct; identical to SEQ ID NO: 101

SEQ ID NO: 753 - protein, 125 aa, synthetic construct
EVQLVESGGGIVQPGGSLRLSCAASGFTFNTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS

SEQ ID NO: 754 - protein, 109 aa, synthetic construct; identical to SEQ ID NO: 101

SEQ ID NO: 755 - protein, 125 aa, synthetic construct; identical to SEQ ID NO: 311

SEQ ID NO: 756 - protein, 109 aa, synthetic construct; identical to SEQ ID NO: 101

SEQ ID NO: 757 - protein, 125 aa, synthetic construct
EVQLVESGGGIVQPGGSLRLSCAASGFTFNTYAMNWVRQAPGKGLEWVGRIRTKTNNYATYYADSVKGRFTISRDDSKNTVYLQMNSLKTEDTAVYYCVRHENFGNSYVSWFAHWGQGTLVTVSS

SEQ ID NO: 758 - protein, 109 aa, synthetic construct; identical to SEQ ID NO: 101

SEQ ID NO: 759 - protein, 125 aa, synthetic construct
EVQLVESGGGIVQPGGSLRLSCAASGFTFSTYAMNWVRQAPGKGLEWVGRIRTKTNNYATYYADSVKGRFTISRDDSKNTVYLQMNSLKTEDTAVYYCVRHENFGNSYVSWFAHWGQGTLVTVSS

SEQ ID NO: 760 - protein, 109 aa, synthetic construct; identical to SEQ ID NO: 101

SEQ ID NO: 761 - protein, 125 aa, synthetic construct
EVQLVESGGGIVQPGGSLRLSCAASGFTFNTYAMNWVRQAPGKGLEWVGRIRTKYNDYATYYADSVKGRFTISRDDSKNTVYLQMNSLKTEDTAVYYCVRHENFGNSYVSWFAHWGQGTLVTVSS

SEQ ID NO: 762 - protein, 109 aa, synthetic construct; identical to SEQ ID NO: 101

SEQ ID NO: 763 - protein, 125 aa, synthetic construct
EVQLVESGGGIVQPGGSLRLSCAASGFTFSTYAMNWVRQAPGKGLEWVGRIRTKYNDYATYYADSVKGRFTISRDDSKNTVYLQMNSLKTEDTAVYYCVRHENFGNSYVSWFAHWGQGTLVTVSS

SEQ ID NO: 764 - protein, 109 aa, synthetic construct; identical to SEQ ID NO: 101

SEQ ID NO: 765 - protein, 125 aa, synthetic construct
EVQLVESGGGIVQPGGSLRLSCAASGFTFNTYAMNWVRQAPGKGLEWVGRIRTKYNNYATTYADSVKGRFTISRDDSKNTVYLQMNSLKTEDTAVYYCVRHENFGNSYVSWFAHWGQGTLVTVSS

SEQ ID NO: 766 - protein, 109 aa, synthetic construct; identical to SEQ ID NO: 101

SEQ ID NO: 767 - protein, 125 aa, synthetic construct
EVQLVESGGGIVQPGGSLRLSCAASGFTFSTYAMNWVRQAPGKGLEWVGRIRTKYNNYATTYADSVKGRFTISRDDSKNTVYLQMNSLKTEDTAVYYCVRHENFGNSYVSWFAHWGQGTLVTVSS

SEQ ID NO: 768 - protein, 109 aa, synthetic construct; identical to SEQ ID NO: 101

SEQ ID NO: 769 - protein, 125 aa, synthetic construct
EVQLVESGGGIVQPGGSLRLSCAASGFTFNTYAMNWVRQAPGKGLEWVGRIRSKYNEYATYYADSVKGRFTISRDDSKNTVYLQMNSLKTEDTAVYYCVRHENFGNSYVSWFAHWGQGTLVTVSS

SEQ ID NO: 770 - protein, 109 aa, synthetic construct; identical to SEQ ID NO: 101

SEQ ID NO: 771 - protein, 125 aa, synthetic construct
EVQLVESGGGIVQPGGSLRLSCAASGFTFNTYAMNWVRQAPGKGLEWVGRIRSKYNNGATYYADSVKGRFTISRDDSKNTVYLQMNSLKTEDTAVYYCVRHENFGNSYVSWFAHWGQGTLVTVSS

SEQ ID NO: 772 - protein, 109 aa, synthetic construct; identical to SEQ ID NO: 101

SEQ ID NO: 773 - protein, 125 aa, synthetic construct
EVQLVESGGGIVQPGGSLRLSCAASGFTFNTYAMNWVRQAPGKGLEWVGRIRSKYNNGATYYADSVKGRFTISRDDSKNTVYLQMNELKTEDTAVYYCVRHENFGNSYVSWFAHWGQGTLVTVSS

SEQ ID NO: 774 - protein, 109 aa, synthetic construct; identical to SEQ ID NO: 101

SEQ ID NO: 775 - protein, 125 aa, synthetic construct
EVQLVESGGGIVQPGGSLRLSCAASGFTFNTYAMNWVRQAPGKGLEWVARIRTKYNNYATTYADSVKDRFTISRDDSKNTVYLQMNSLKTEDTAVYYCVRHENFGNSYVSWFAHWGQGTLVTVSS

SEQ ID NO: 776 - protein, 109 aa, synthetic construct; identical to SEQ ID NO: 101

SEQ ID NO: 777 - protein, 125 aa, synthetic construct
EVQLVESGGGIVQPGGSLRLSCAASGFTFNTYAMNWVRQAPGKGLEWVARIRSKRNNYATTYADSVKDRFTISRDDSKNTVYLQMNSLKTEDTAVYYCVRHENFGNSYVSWFAHWGQGTLVTVSS

SEQ ID NO: 778 - protein, 109 aa, synthetic construct; identical to SEQ ID NO: 101

SEQ ID NO: 779 - protein, 125 aa, synthetic construct
EVQLVESGGGIVQPGGSLRLSCAASGFTFNTYAMNWVRQAPGKGLEWVARIRSKKNNYATTYADSVKDRFTISRDDSKNTVYLQMNSLKTEDTAVYYCVRHENFGNSYVSWFAHWGQGTLVTVSS

SEQ ID NO: 780 - protein, 109 aa, synthetic construct; identical to SEQ ID NO: 101

SEQ ID NO: 781 - protein, 125 aa, synthetic construct
EVQLVESGGGIVQPGGSLRLSCAASGFTFNTYAMNWVRQAPGKGLEWVARIRSKTNNYATTYADSVKDRFTISRDDSKNTVYLQMNSLKTEDTAVYYCVRHENFGNSYVSWFAHWGQGTLVTVSS

SEQ ID NO: 782 - protein, 109 aa, synthetic construct; identical to SEQ ID NO: 101

SEQ ID NO: 783 - protein, 125 aa, synthetic construct
EVQLVESGGGIVQPGGSLRLSCAASGFTFNTYAMNWVRQAPGKGLEWVGRIRSKYNDYATYYADSVKGRFTISRDDSKNTLYLQMNSLKTEDTAVYYCVRHENFGNSYVSWFAHWGQGTLVTVSS

SEQ ID NO: 784 - protein, 109 aa, synthetic construct; identical to SEQ ID NO: 101

SEQ ID NO: 785 - protein, 125 aa, synthetic construct
EVQLVESGGGIVQPGGSLRLSCAASGFTFNTYAMNWVRQAPGKGLEWVGRIRSKYNEYATYYADSVKGRFTISRDDSKNTLYLQMNSLKTEDTAVYYCVRHENFGNSYVSWFAHWGQGTLVTVSS

SEQ ID NO: 786 - protein, 109 aa, synthetic construct; identical to SEQ ID NO: 101

SEQ ID NO: 787 - protein, 125 aa, synthetic construct
EVQLVESGGGIVQPGGSLRLSCAASGFTFNTYAMNWVRQAPGKGLEWVGRIRSKYNNGATYYADSVKGRFTISRDDSKNTLYLQMNSLKTEDTAVYYCVRHENFGNSYVSWFAHWGQGTLVTVSS

SEQ ID NO: 788 - protein, 109 aa, synthetic construct; identical to SEQ ID NO: 101

SEQ ID NO: 789 - protein, 125 aa, synthetic construct
EVQLVESGGGIVQPGGSLRLSCAASGFTFNTYAMNWVRQAPGKGLEWVGRIRSKYNNGATYYADSVKGRFTISRDDSKNTLYLQMNELKTEDTAVYYCVRHENFGNSYVSWFAHWGQGTLVTVSS

SEQ ID NO: 790 - protein, 109 aa, synthetic construct; identical to SEQ ID NO: 101

SEQ ID NO: 791 - protein, 125 aa, synthetic construct
EVQLVESGGGIVQPGGSLRLSCAASGFTFNTYAMNWVRQAPGKGLEWVARIRTKYNNYATTYADSVKDRFTISRDDSKNTLYLQMNSLKTEDTAVYYCVRHENFGNSYVSWFAHWGQGTLVTVSS

SEQ ID NO: 792 - protein, 109 aa, synthetic construct; identical to SEQ ID NO: 101

SEQ ID NO: 793 - protein, 125 aa, synthetic construct
EVQLVESGGGIVQPGGSLRLSCAASGFTFNTYAMNWVRQAPGKGLEWVARIRSKRNNYATTYADSVKDRFTISRDDSKNTLYLQMNSLKTEDTAVYYCVRHENFGNSYVSWFAHWGQGTLVTVSS

SEQ ID NO: 794 - protein, 109 aa, synthetic construct; identical to SEQ ID NO: 101

SEQ ID NO: 795 - protein, 125 aa, synthetic construct
EVQLVESGGGIVQPGGSLRLSCAASGFTFNTYAMNWVRQAPGKGLEWVARIRSKKNNYATTYADSVKDRFTISRDDSKNTLYLQMNSLKTEDTAVYYCVRHENFGNSYVSWFAHWGQGTLVTVSS

SEQ ID NO: 796 - protein, 109 aa, synthetic construct; identical to SEQ ID NO: 101

SEQ ID NO: 797 - protein, 125 aa, synthetic construct
EVQLVESGGGIVQPGGSLRLSCAASGFTFNTYAMNWVRQAPGKGLEWVARIRSKTNNYATTYADSVKDRFTISRDDSKNTLYLQMNSLKTEDTAVYYCVRHENFGNSYVSWFAHWGQGTLVTVSS

SEQ ID NO: 798 - protein, 109 aa, synthetic construct; identical to SEQ ID NO: 101

SEQ ID NO: 799 - protein, 125 aa, synthetic construct
EVQLVESGGGIVQPGGSLRLSCAASGFTFNTYAMNWVRQAPGKGLEWVGRIRTKYNNYATTYADSVKDRFTISRDDSKNTVYLQMNSLKTEDTAVYYCVRHENFGNSYVSWFAHWGQGTLVTVSS

SEQ ID NO: 800 - protein, 109 aa, synthetic construct; identical to SEQ ID NO: 101

SEQ ID NO: 801 - protein, 125 aa, synthetic construct
EVQLVESGGGIVQPGGSLRLSCAASGFTFNTYAMNWVRQAPGKGLEWVGRIRSKRNNYATTYADSVKDRFTISRDDSKNTVYLQMNSLKTEDTAVYYCVRHENFGNSYVSWFAHWGQGTLVTVSS

SEQ ID NO: 802 - protein, 109 aa, synthetic construct; identical to SEQ ID NO: 101

SEQ ID NO: 803 - protein, 125 aa, synthetic construct
EVQLVESGGGIVQPGGSLRLSCAASGFTFNTYAMNWVRQAPGKGLEWVGRIRSKKNNYATTYADSVKDRFTISRDDSKNTVYLQMNSLKTEDTAVYYCVRHENFGNSYVSWFAHWGQGTLVTVSS

SEQ ID NO: 804 - protein, 109 aa, synthetic construct; identical to SEQ ID NO: 101

SEQ ID NO: 805 - protein, 125 aa, synthetic construct
EVQLVESGGGIVQPGGSLRLSCAASGFTFNTYAMNWVRQAPGKGLEWVGRIRSKTNNYATTYADSVKDRFTISRDDSKNTVYLQMNSLKTEDTAVYYCVRHENFGNSYVSWFAHWGQGTLVTVSS

SEQ ID NO: 806 - protein, 109 aa, synthetic construct; identical to SEQ ID NO: 101

SEQ ID NO: 807 - protein, 125 aa, synthetic construct
EVQLVESGGGIVQPGGSLRLSCAASGFTFNTYAMNWVRQAPGKGLEWVGRIRTKYNNYATTYADSVKDRFTISRDDSKNTVYLQMNELKTEDTAVYYCVRHENFGNSYVSWFAHWGQGTLVTVSS

SEQ ID NO: 808 - protein, 109 aa, synthetic construct; identical to SEQ ID NO: 101

SEQ ID NO: 809 - protein, 125 aa, synthetic construct
EVQLVESGGGIVQPGGSLRLSCAASGFTFNTYAMNWVRQAPGKGLEWVGRIRSKRNNYATTYADSVKDRFTISRDDSKNTVYLQMNELKTEDTAVYYCVRHENFGNSYVSWFAHWGQGTLVTVSS

SEQ ID NO: 810 - protein, 109 aa, synthetic construct; identical to SEQ ID NO: 101

SEQ ID NO: 811 - protein, 125 aa, synthetic construct
EVQLVESGGGIVQPGGSLRLSCAASGFTFNTYAMNWVRQAPGKGLEWVGRIRSKKNNYATTYADSVKDRFTISRDDSKNTVYLQMNELKTEDTAVYYCVRHENFGNSYVSWFAHWGQGTLVTVSS

SEQ ID NO: 812 - protein, 109 aa, synthetic construct; identical to SEQ ID NO: 101

SEQ ID NO: 813 - protein, 125 aa, synthetic construct
EVQLVESGGGIVQPGGSLRLSCAASGFTFNTYAMNWVRQAPGKGLEWVGRIRSKTNNYATTYADSVKDRFTISRDDSKNTVYLQMNELKTEDTAVYYCVRHENFGNSYVSWFAHWGQGTLVTVSS

SEQ ID NO: 814 - protein, 109 aa, synthetic construct; identical to SEQ ID NO: 101

SEQ ID NO: 815 - protein, 125 aa, synthetic construct
EVQLVESGGGIVQPGGSLRLSCAASGFTFNTYAMNWVRQAPGKGLEWVGRIRTKYNNYATTYADSVKDRFTISRDDSKNTLYLQMNSLKTEDTAVYYCVRHENFGNSYVSWFAHWGQGTLVTVSS

SEQ ID NO: 816 - protein, 109 aa, synthetic construct; identical to SEQ ID NO: 101

SEQ ID NO: 817 - protein, 125 aa, synthetic construct
EVQLVESGGGIVQPGGSLRLSCAASGFTFNTYAMNWVRQAPGKGLEWVGRIRSKRNNYATTYADSVKDRFTISRDDSKNTLYLQMNSLKTEDTAVYYCVRHENFGNSYVSWFAHWGQGTLVTVSS

SEQ ID NO: 818 - protein, 109 aa, synthetic construct; identical to SEQ ID NO: 101

SEQ ID NO: 819 - protein, 125 aa, synthetic construct
EVQLVESGGGIVQPGGSLRLSCAASGFTFNTYAMNWVRQAPGKGLEWVGRIRSKKNNYATTYADSVKDRFTISRDDSKNTLYLQMNSLKTEDTAVYYCVRHENFGNSYVSWFAHWGQGTLVTVSS

SEQ ID NO: 820 - protein, 109 aa, synthetic construct; identical to SEQ ID NO: 101

SEQ ID NO: 821 - protein, 125 aa, synthetic construct
EVQLVESGGGIVQPGGSLRLSCAASGFTFNTYAMNWVRQAPGKGLEWVGRIRSKTNNYATTYADSVKDRFTISRDDSKNTLYLQMNSLKTEDTAVYYCVRHENFGNSYVSWFAHWGQGTLVTVSS

SEQ ID NO: 822 - protein, 109 aa, synthetic construct; identical to SEQ ID NO: 101

SEQ ID NO: 823 - protein, 125 aa, synthetic construct
EVQLVESGGGIVQPGGSLRLSCAASGFTFNTYAMNWVRQAPGKGLEWVGRIRSKRNNYATTYADSVKDRFTISRDDSKNTLYLQMNELKTEDTAVYYCVRHENFGNSYVSWFAHWGQGTLVTVSS

SEQ ID NO: 824 - protein, 109 aa, synthetic construct; identical to SEQ ID NO: 101

SEQ ID NO: 825 - protein, 125 aa, synthetic construct
EVQLVESGGGIVQPGGSLKLSCAASGFTFNTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS

SEQ ID NO: 826 - protein, 109 aa, synthetic construct; identical to SEQ ID NO: 101

SEQ ID NO: 827 - protein, 125 aa, synthetic construct
EVQLVESGGGIVQPGGSLKLSCAASGFTFSTYAMNWVRQAPGKGLEWVGRIRTKRNNYATYYADSVKGRFTISRDDSKNTVYLQMNSLKTEDTAVYYCVRHENFGNSYVSWFAHWGQGTLVTVSS

SEQ ID NO: 828 - protein, 109 aa, synthetic construct; identical to SEQ ID NO: 101

SEQ ID NO: 829 - protein, 125 aa, synthetic construct; identical to SEQ ID NO: 102

SEQ ID NO: 830 - protein, 109 aa, synthetic construct; identical to SEQ ID NO: 101

SEQ ID NO: 831 - protein, 125 aa, synthetic construct
EVQLLESGGGIVQPGGSLKLSCAASGFTFNTYAMNWVRQAPGKGLEWVGRIRSKYNNGATYYADSVKGRFTISRDDSKNTVYLQMNSLKTEDTAVYYCVRHENFGNSYVSWFAHWGQGTLVTVSS

SEQ ID NO: 832 - protein, 109 aa, synthetic construct; identical to SEQ ID NO: 101

SEQ ID NO: 833 - protein, 125 aa, synthetic construct; identical to SEQ ID NO: 102

SEQ ID NO: 834 - protein, 109 aa, synthetic construct; identical to SEQ ID NO: 101

SEQ ID NO: 835 - protein, 125 aa, synthetic construct; identical to SEQ ID NO: 102

SEQ ID NO: 836 - protein, 109 aa, synthetic construct; identical to SEQ ID NO: 101

SEQ ID NO: 837 - protein, 125 aa, synthetic construct; identical to SEQ ID NO: 102

SEQ ID NO: 838 - protein, 109 aa, synthetic construct; identical to SEQ ID NO: 101

SEQ ID NO: 839 - protein, 125 aa, synthetic construct
EVQLLESGGGIVQPGGSLKLSCAASGFTFNTYAMNWVRQAPGKGLEDVARIRSKYNNYATYYADSVKDRFTISRDDSKNTVYLQMNNLKTEDTAVYYCVRHENFGNSYVSWFAHWGQGTLVTVSS

SEQ ID NO: 840 - protein, 109 aa, synthetic construct; identical to SEQ ID NO: 101

SEQ ID NO: 841 - protein, 125 aa, synthetic construct
EVQLLESGGGIVQPGGSLKLSCAASGFTFNTYAMNWVRQAPGKGLEEVARIRSKYNNYATYYADSVKDRFTISRDDSKNTVYLQMNNLKTEDTAVYYCVRHENFGNSYVSWFAHWGQGTLVTVSS

SEQ ID NO: 842 - protein, 109 aa, synthetic construct; identical to SEQ ID NO: 101

SEQ ID NO: 843 - protein, 125 aa, synthetic construct
EVQLLESGGGIVQPGGSLKLSCAASGFTFNTYAMNWVRQAPGKGLEWAARIRSKYNNYATYYADSVKDRFTISRDDSKNTVYLQMNNLKTEDTAVYYCVRHENFGNSYVSWFAHWGQGTLVTVSS

SEQ ID NO: 844 - protein, 109 aa, synthetic construct; identical to SEQ ID NO: 101

SEQ ID NO: 845 - protein, 125 aa, synthetic construct
EVQLLESGGGIVQPGGSLKLSCAASGFTFNTYAMNWVRQAPGKGLEWEARIRSKYNNYATYYADSVKDRFTISRDDSKNTVYLQMNNLKTEDTAVYYCVRHENFGNSYVSWFAHWGQGTLVTVSS

SEQ ID NO: 846 - protein, 109 aa, synthetic construct; identical to SEQ ID NO: 101

SEQ ID NO: 847 - protein, 125 aa, synthetic construct
EVQLLESGGGIVQPGGSLKLSCAASGFTFNTYAMNWVRQAPGKGLEWGARIRSKYNNYATYYADSVKDRFTISRDDSKNTVYLQMNNLKTEDTAVYYCVRHENFGNSYVSWFAHWGQGTLVTVSS

SEQ ID NO: 848 - protein, 109 aa, synthetic construct; identical to SEQ ID NO: 101

SEQ ID NO: 849 - protein, 125 aa, synthetic construct
EVQLLESGGGIVQPGGSLKLSCAASGFTFNTYAMNWVRQAPGKGLEWSARIRSKYNNYATYYADSVKDRFTISRDDSKNTVYLQMNNLKTEDTAVYYCVRHENFGNSYVSWFAHWGQGTLVTVSS

SEQ ID NO: 850 - protein, 109 aa, synthetic construct; identical to SEQ ID NO: 101

SEQ ID NO: 851 - protein, 125 aa, synthetic construct
EVQLLESGGGIVQPGGSLKLSCAASGFTFNTYAMNWVRQAPGKGLEWTARIRSKYNNYATYYADSVKDRFTISRDDSKNTVYLQMNNLKTEDTAVYYCVRHENFGNSYVSWFAHWGQGTLVTVSS

SEQ ID NO: 852 - protein, 109 aa, synthetic construct; identical to SEQ ID NO: 101

SEQ ID NO: 853 - protein, 125 aa, synthetic construct
EVQLLESGGGIVQPGGSLKLSCAASGFTFNTYAMNWVRQAPGKGLEWWARIRSKYNNYATYYADSVKDRFTISRDDSKNTVYLQMNNLKTEDTAVYYCVRHENFGNSYVSWFAHWGQGTLVTVSS

SEQ ID NO: 854 - protein, 109 aa, synthetic construct; identical to SEQ ID NO: 101

SEQ ID NO: 855 - protein, 125 aa, synthetic construct
EVQLLESGGGIVQPGGSLKLSCAASGFTFNTYAMNWVRQAPGKGLEWVDRIRSKYNNYATYYADSVKDRFTISRDDSKNTVYLQMNNLKTEDTAVYYCVRHENFGNSYVSWFAHWGQGTLVTVSS

SEQ ID NO: 856 - protein, 109 aa, synthetic construct; identical to SEQ ID NO: 101

SEQ ID NO: 857 - protein, 125 aa, synthetic construct
EVQLLESGGGIVQPGGSLKLSCAASGFTFNTYAMNWVRQAPGKGLEWVERIRSKYNNYATYYADSVKDRFTISRDDSKNTVYLQMNNLKTEDTAVYYCVRHENFGNSYVSWFAHWGQGTLVTVSS

SEQ ID NO: 858 - protein, 109 aa, synthetic construct; identical to SEQ ID NO: 101

SEQ ID NO: 859 - protein, 125 aa, synthetic construct
EVQLLESGGGIVQPGGSLKLSCAASGFTFNTYAMNWVRQAPGKGLEWVGRIRSKYNNYATYYADSVKDRFTISRDDSKNTVYLQMNNLKTEDTAVYYCVRHENFGNSYVSWFAHWGQGTLVTVSS

SEQ ID NO: 860 - protein, 109 aa, synthetic construct; identical to SEQ ID NO: 101

SEQ ID NO: 861 - protein, 125 aa, synthetic construct
EVQLLESGGGIVQPGGSLKLSCAASGFTFNTYAMNWVRQAPGKGLEWVAQIRSKYNNYATYYADSVKDRFTISRDDSKNTVYLQMNNLKTEDTAVYYCVRHENFGNSYVSWFAHWGQGTLVTVSS

SEQ ID NO: 862 - protein, 109 aa, synthetic construct; identical to SEQ ID NO: 101

SEQ ID NO: 863 - protein, 125 aa, synthetic construct
EVQLLESGGGIVQPGGSLKLSCAASGFTFNTYAMNWVRQAPGKGLEWVAGIRSKYNNYATYYADSVKDRFTISRDDSKNTVYLQMNNLKTEDTAVYYCVRHENFGNSYVSWFAHWGQGTLVTVSS

SEQ ID NO: 864 - protein, 109 aa, synthetic construct; identical to SEQ ID NO: 101

SEQ ID NO: 865 - protein, 125 aa, synthetic construct
EVQLLESGGGIVQPGGSLKLSCAASGFTFNTYAMNWVRQAPGKGLEWVAHIRSKYNNYATYYADSVKDRFTISRDDSKNTVYLQMNNLKTEDTAVYYCVRHENFGNSYVSWFAHWGQGTLVTVSS

SEQ ID NO: 866 - protein, 109 aa, synthetic construct; identical to SEQ ID NO: 101

SEQ ID NO: 867 - protein, 125 aa, synthetic construct
EVQLLESGGGIVQPGGSLKLSCAASGFTFNTYAMNWVRQAPGKGLEWVAPIRSKYNNYATYYADSVKDRFTISRDDSKNTVYLQMNNLKTEDTAVYYCVRHENFGNSYVSWFAHWGQGTLVTVSS

SEQ ID NO: 868 - protein, 109 aa, synthetic construct; identical to SEQ ID NO: 101

SEQ ID NO: 869 - protein, 125 aa, synthetic construct
EVQLLESGGGIVQPGGSLKLSCAASGFTFNTYAMNWVRQAPGKGLEWVAWIRSKYNNYATYYADSVKDRFTISRDDSKNTVYLQMNNLKTEDTAVYYCVRHENFGNSYVSWFAHWGQGTLVTVSS

SEQ ID NO: 870 - protein, 109 aa, synthetic construct; identical to SEQ ID NO: 101

SEQ ID NO: 871 - protein, 125 aa, synthetic construct
EVQLLESGGGIVQPGGSLKLSCAASGFTFNTYAMNWVRQAPGKGLEWVARARSKYNNYATYYADSVKDRFTISRDDSKNTVYLQMNNLKTEDTAVYYCVRHENFGNSYVSWFAHWGQGTLVTVSS

SEQ ID NO: 872 - protein, 109 aa, synthetic construct; identical to SEQ ID NO: 101

SEQ ID NO: 873 - protein, 125 aa, synthetic construct
EVQLLESGGGIVQPGGSLKLSCAASGFTFNTYAMNWVRQAPGKGLEWVARGRSKYNNYATYYADSVKDRFTISRDDSKNTVYLQMNNLKTEDTAVYYCVRHENFGNSYVSWFAHWGQGTLVTVSS

SEQ ID NO: 874 - protein, 109 aa, synthetic construct; identical to SEQ ID NO: 101

SEQ ID NO: 875 - protein, 125 aa, synthetic construct
EVQLLESGGGIVQPGGSLKLSCAASGFTFNTYAMNWVRQAPGKGLEWVARTRSKYNNYATYYADSVKDRFTISRDDSKNTVYLQMNNLKTEDTAVYYCVRHENFGNSYVSWFAHWGQGTLVTVSS

SEQ ID NO: 876 - protein, 109 aa, synthetic construct; identical to SEQ ID NO: 101

SEQ ID NO: 877 - protein, 125 aa, synthetic construct
EVQLLESGGGIVQPGGSLKLSCAASGFTFNTYAMNWVRQAPGKGLEWVARINSKYNNYATYYADSVKDRFTISRDDSKNTVYLQMNNLKTEDTAVYYCVRHENFGNSYVSWFAHWGQGTLVTVSS

SEQ ID NO: 878 - protein, 109 aa, synthetic construct; identical to SEQ ID NO: 101

SEQ ID NO: 879 - protein, 125 aa, synthetic construct
EVQLLESGGGIVQPGGSLKLSCAASGFTFNTYAMNWVRQAPGKGLEWVARIDSKYNNYATYYADSVKDRFTISRDDSKNTVYLQMNNLKTEDTAVYYCVRHENFGNSYVSWFAHWGQGTLVTVSS

SEQ ID NO: 880 - protein, 109 aa, synthetic construct; identical to SEQ ID NO: 101

SEQ ID NO: 881 - protein, 125 aa, synthetic construct
EVQLLESGGGIVQPGGSLKLSCAASGFTFNTYAMNWVRQAPGKGLEWVARIESKYNNYATYYADSVKDRFTISRDDSKNTVYLQMNNLKTEDTAVYYCVRHENFGNSYVSWFAHWGQGTLVTVSS

SEQ ID NO: 882 - protein, 109 aa, synthetic construct; identical to SEQ ID NO: 101

SEQ ID NO: 883 - protein, 125 aa, synthetic construct
EVQLLESGGGIVQPGGSLKLSCAASGFTFNTYAMNWVRQAPGKGLEWVARIQSKYNNYATYYADSVKDRFTISRDDSKNTVYLQMNNLKTEDTAVYYCVRHENFGNSYVSWFAHWGQGTLVTVSS

SEQ ID NO: 884 - protein, 109 aa, synthetic construct; identical to SEQ ID NO: 101

SEQ ID NO: 885 - protein, 125 aa, synthetic construct
EVQLLESGGGIVQPGGSLKLSCAASGFTFNTYAMNWVRQAPGKGLEWVARIGSKYNNYATYYADSVKDRFTISRDDSKNTVYLQMNNLKTEDTAVYYCVRHENFGNSYVSWFAHWGQGTLVTVSS

SEQ ID NO: 886 - protein, 109 aa, synthetic construct; identical to SEQ ID NO: 101

SEQ ID NO: 887 - protein, 125 aa, synthetic construct
EVQLLESGGGIVQPGGSLKLSCAASGFTFNTYAMNWVRQAPGKGLEWVARIHSKYNNYATYYADSVKDRFTISRDDSKNTVYLQMNNLKTEDTAVYYCVRHENFGNSYVSWFAHWGQGTLVTVSS

SEQ ID NO: 888 - protein, 109 aa, synthetic construct; identical to SEQ ID NO: 101

SEQ ID NO: 889 - protein, 125 aa, synthetic construct
EVQLLESGGGIVQPGGSLKLSCAASGFTFNTYAMNWVRQAPGKGLEWVARIWSKYNNYATYYADSVKDRFTISRDDSKNTVYLQMNNLKTEDTAVYYCVRHENFGNSYVSWFAHWGQGTLVTVSS

SEQ ID NO: 890 - protein, 109 aa, synthetic construct; identical to SEQ ID NO: 101

SEQ ID NO: 891 - protein, 125 aa, synthetic construct
EVQLLESGGGIVQPGGSLKLSCAASGFTFNTYAMNWVRQAPGKGLEWVARIRNKYNNYATYYADSVKDRFTISRDDSKNTVYLQMNNLKTEDTAVYYCVRHENFGNSYVSWFAHWGQGTLVTVSS

SEQ ID NO: 892 - protein, 109 aa, synthetic construct; identical to SEQ ID NO: 101

SEQ ID NO: 893 - protein, 125 aa, synthetic construct
EVQLLESGGGIVQPGGSLKLSCAASGFTFNTYAMNWVRQAPGKGLEWVARIRDKYNNYATYYADSVKDRFTISRDDSKNTVYLQMNNLKTEDTAVYYCVRHENFGNSYVSWFAHWGQGTLVTVSS

SEQ ID NO: 894 - protein, 109 aa, synthetic construct; identical to SEQ ID NO: 101

SEQ ID NO: 895 - protein, 125 aa, synthetic construct
EVQLLESGGGIVQPGGSLKLSCAASGFTFNTYAMNWVRQAPGKGLEWVARIREKYNNYATYYADSVKDRFTISRDDSKNTVYLQMNNLKTEDTAVYYCVRHENFGNSYVSWFAHWGQGTLVTVSS

SEQ ID NO: 896 - protein, 109 aa, synthetic construct; identical to SEQ ID NO: 101

SEQ ID NO: 897 - protein, 125 aa, synthetic construct
EVQLLESGGGIVQPGGSLKLSCAASGFTFNTYAMNWVRQAPGKGLEWVARIRTKYNNYATYYADSVKDRFTISRDDSKNTVYLQMNNLKTEDTAVYYCVRHENFGNSYVSWFAHWGQGTLVTVSS

SEQ ID NO: 898 - protein, 109 aa, synthetic construct; identical to SEQ ID NO: 101

SEQ ID NO: 899 - protein, 125 aa, synthetic construct
EVQLLESGGGIVQPGGSLKLSCAASGFTFNTYAMNWVRQAPGKGLEWVARIRSPYNNYATYYADSVKDRFTISRDDSKNTVYLQMNNLKTEDTAVYYCVRHENFGNSYVSWFAHWGQGTLVTVSS

SEQ ID NO: 900 - protein, 109 aa, synthetic construct; identical to SEQ ID NO: 101

SEQ ID NO: 901 - protein, 125 aa, synthetic construct
EVQLLESGGGIVQPGGSLKLSCAASGFTFNTYAMNWVRQAPGKGLEWVARIRSKANNYATYYADSVKDRFTISRDDSKNTVYLQMNNLKTEDTAVYYCVRHENFGNSYVSWFAHWGQGTLVTVSS

SEQ ID NO: 902 - protein, 109 aa, synthetic construct; identical to SEQ ID NO: 101

SEQ ID NO: 903 - protein, 125 aa, synthetic construct
EVQLLESGGGIVQPGGSLKLSCAASGFTFNTYAMNWVRQAPGKGLEWVARIRSKRNNYATYYADSVKDRFTISRDDSKNTVYLQMNNLKTEDTAVYYCVRHENFGNSYVSWFAHWGQGTLVTVSS

SEQ ID NO: 904 - protein, 109 aa, synthetic construct; identical to SEQ ID NO: 101

SEQ ID NO: 905 - protein, 125 aa, synthetic construct
EVQLLESGGGIVQPGGSLKLSCAASGFTFNTYAMNWVRQAPGKGLEWVARIRSKGNNYATYYADSVKDRFTISRDDSKNTVYLQMNNLKTEDTAVYYCVRHENFGNSYVSWFAHWGQGTLVTVSS

SEQ ID NO: 906 - protein, 109 aa, synthetic construct; identical to SEQ ID NO: 101

SEQ ID NO: 907 - protein, 125 aa, synthetic construct
EVQLLESGGGIVQPGGSLKLSCAASGFTFNTYAMNWVRQAPGKGLEWVARIRSKKNNYATYYADSVKDRFTISRDDSKNTVYLQMNNLKTEDTAVYYCVRHENFGNSYVSWFAHWGQGTLVTVSS

SEQ ID NO: 908 - protein, 109 aa, synthetic construct; identical to SEQ ID NO: 101

SEQ ID NO: 909 - protein, 125 aa, synthetic construct
EVQLLESGGGIVQPGGSLKLSCAASGFTFNTYAMNWVRQAPGKGLEWVARIRSKPNNYATYYADSVKDRFTISRDDSKNTVYLQMNNLKTEDTAVYYCVRHENFGNSYVSWFAHWGQGTLVTVSS

SEQ ID NO: 910 - protein, 109 aa, synthetic construct; identical to SEQ ID NO: 101

SEQ ID NO: 911 - protein, 125 aa, synthetic construct
EVQLLESGGGIVQPGGSLKLSCAASGFTFNTYAMNWVRQAPGKGLEWVARIRSKTNNYATYYADSVKDRFTISRDDSKNTVYLQMNNLKTEDTAVYYCVRHENFGNSYVSWFAHWGQGTLVTVSS

SEQ ID NO: 912 - protein, 109 aa, synthetic construct; identical to SEQ ID NO: 101

SEQ ID NO: 913 - protein, 125 aa, synthetic construct
EVQLLESGGGIVQPGGSLKLSCAASGFTFNTYAMNWVRQAPGKGLEWVARIRSKWNNYATYYADSVKDRFTISRDDSKNTVYLQMNNLKTEDTAVYYCVRHENFGNSYVSWFAHWGQGTLVTVSS

SEQ ID NO: 914 - protein, 109 aa, synthetic construct; identical to SEQ ID NO: 101

SEQ ID NO: 915 - protein, 125 aa, synthetic construct
EVQLLESGGGIVQPGGSLKLSCAASGFTFNTYAMNWVRQAPGKGLEWVARIRSKYDNYATYYADSVKDRFTISRDDSKNTVYLQMNNLKTEDTAVYYCVRHENFGNSYVSWFAHWGQGTLVTVSS

SEQ ID NO: 916 - protein, 109 aa, synthetic construct; identical to SEQ ID NO: 101

SEQ ID NO: 917 - protein, 125 aa, synthetic construct
EVQLLESGGGIVQPGGSLKLSCAASGFTFNTYAMNWVRQAPGKGLEWVARIRSKYENYATYYADSVKDRFTISRDDSKNTVYLQMNNLKTEDTAVYYCVRHENFGNSYVSWFAHWGQGTLVTVSS

SEQ ID NO: 918 - protein, 109 aa, synthetic construct; identical to SEQ ID NO: 101

SEQ ID NO: 919 - protein, 125 aa, synthetic construct
EVQLLESGGGIVQPGGSLKLSCAASGFTFNTYAMNWVRQAPGKGLEWVARIRSKYNDYATYYADSVKDRFTISRDDSKNTVYLQMNNLKTEDTAVYYCVRHENFGNSYVSWFAHWGQGTLVTVSS

SEQ ID NO: 920 - protein, 109 aa, synthetic construct; identical to SEQ ID NO: 101

SEQ ID NO: 921 - protein, 125 aa, synthetic construct
EVQLLESGGGIVQPGGSLKLSCAASGFTFNTYAMNWVRQAPGKGLEWVARIRSKYNEYATYYADSVKDRFTISRDDSKNTVYLQMNNLKTEDTAVYYCVRHENFGNSYVSWFAHWGQGTLVTVSS

SEQ ID NO: 922 - protein, 109 aa, synthetic construct; identical to SEQ ID NO: 101

SEQ ID NO: 923 - protein, 125 aa, synthetic construct
EVQLLESGGGIVQPGGSLKLSCAASGFTFNTYAMNWVRQAPGKGLEWVARIRSKYNNGATYYADSVKDRFTISRDDSKNTVYLQMNNLKTEDTAVYYCVRHENFGNSYVSWFAHWGQGTLVTVSS

SEQ ID NO: 924 - protein, 109 aa, synthetic construct; identical to SEQ ID NO: 101

SEQ ID NO: 925 - protein, 125 aa, synthetic construct
EVQLLESGGGIVQPGGSLKLSCAASGFTFNTYAMNWVRQAPGKGLEWVARIRSKYNNFATYYADSVKDRFTISRDDSKNTVYLQMNNLKTEDTAVYYCVRHENFGNSYVSWFAHWGQGTLVTVSS

SEQ ID NO: 926 - protein, 109 aa, synthetic construct; identical to SEQ ID NO: 101

SEQ ID NO: 927 - protein, 125 aa, synthetic construct
EVQLLESGGGIVQPGGSLKLSCAASGFTFNTYAMNWVRQAPGKGLEWVARIRSKYNNWATYYADSVKDRFTISRDDSKNTVYLQMNNLKTEDTAVYYCVRHENFGNSYVSWFAHWGQGTLVTVSS

SEQ ID NO: 928 - protein, 109 aa, synthetic construct; identical to SEQ ID NO: 101

SEQ ID NO: 929 - protein, 125 aa, synthetic construct
EVQLLESGGGIVQPGGSLKLSCAASGFTFNTYAMNWVRQAPGKGLEWVARIRSKYNNYGTYYADSVKDRFTISRDDSKNTVYLQMNNLKTEDTAVYYCVRHENFGNSYVSWFAHWGQGTLVTVSS

SEQ ID NO: 930 - protein, 109 aa, synthetic construct; identical to SEQ ID NO: 101

SEQ ID NO: 931 - protein, 125 aa, synthetic construct
EVQLLESGGGIVQPGGSLKLSCAASGFTFNTYAMNWVRQAPGKGLEWVARIRSKYNNYTTYYADSVKDRFTISRDDSKNTVYLQMNNLKTEDTAVYYCVRHENFGNSYVSWFAHWGQGTLVTVSS

SEQ ID NO: 932 - protein, 109 aa, synthetic construct; identical to SEQ ID NO: 101

SEQ ID NO: 933 - protein, 125 aa, synthetic construct
EVQLLESGGGIVQPGGSLKLSCAASGFTFNTYAMNWVRQAPGKGLEWVARIRSKYNNYATDYADSVKDRFTISRDDSKNTVYLQMNNLKTEDTAVYYCVRHENFGNSYVSWFAHWGQGTLVTVSS

SEQ ID NO: 934 - protein, 109 aa, synthetic construct; identical to SEQ ID NO: 101

SEQ ID NO: 935 - protein, 125 aa, synthetic construct
EVQLLESGGGIVQPGGSLKLSCAASGFTFNTYAMNWVRQAPGKGLEWVARIRSKYNNYATEYADSVKDRFTISRDDSKNTVYLQMNNLKTEDTAVYYCVRHENFGNSYVSWFAHWGQGTLVTVSS

SEQ ID NO: 936 - protein, 109 aa, synthetic construct; identical to SEQ ID NO: 101

SEQ ID NO: 937 - protein, 125 aa, synthetic construct
EVQLLESGGGIVQPGGSLKLSCAASGFTFNTYAMNWVRQAPGKGLEWVARIRSKYNNYATTYADSVKDRFTISRDDSKNTVYLQMNNLKTEDTAVYYCVRHENFGNSYVSWFAHWGQGTLVTVSS

SEQ ID NO: 938 - protein, 109 aa, synthetic construct; identical to SEQ ID NO: 101

SEQ ID NO: 939 - protein, 125 aa, synthetic construct
EVQLLESGGGIVQPGGSLKLSCAASGFTFNTYAMNWVRQAPGKGLEWVARIRSKYNNYATYDADSVKDRFTISRDDSKNTVYLQMNNLKTEDTAVYYCVRHENFGNSYVSWFAHWGQGTLVTVSS

SEQ ID NO: 940 - protein, 109 aa, synthetic construct; identical to SEQ ID NO: 101

SEQ ID NO: 941 - protein, 125 aa, synthetic construct
EVQLLESGGGIVQPGGSLKLSCAASGFTFNTYAMNWVRQAPGKGLEWVARIRSKYNNYATYEADSVKDRFTISRDDSKNTVYLQMNNLKTEDTAVYYCVRHENFGNSYVSWFAHWGQGTLVTVSS

SEQ ID NO: 942 - protein, 109 aa, synthetic construct; identical to SEQ ID NO: 101

SEQ ID NO: 943 - protein, 125 aa, synthetic construct
EVQLLESGGGIVQPGGSLKLSCAASGFTFNTYAMNWVRQAPGKGLEWVARIRSKYNNYATYQADSVKDRFTISRDDSKNTVYLQMNNLKTEDTAVYYCVRHENFGNSYVSWFAHWGQGTLVTVSS

SEQ ID NO: 944 - protein, 109 aa, synthetic construct; identical to SEQ ID NO: 101

SEQ ID NO: 945 - protein, 125 aa, synthetic construct
EVQLLESGGGIVQPGGSLKLSCAASGFTFNTYAMNWVRQAPGKGLEWVARIRSKYNNYATYGADSVKDRFTISRDDSKNTVYLQMNNLKTEDTAVYYCVRHENFGNSYVSWFAHWGQGTLVTVSS

SEQ ID NO: 946 - protein, 109 aa, synthetic construct; identical to SEQ ID NO: 101

SEQ ID NO: 947 - protein, 125 aa, synthetic construct
EVQLLESGGGIVQPGGSLKLSCAASGFTFNTYAMNWVRQAPGKGLEWVARIRSKYNNYATYWADSVKDRFTISRDDSKNTVYLQMNNLKTEDTAVYYCVRHENFGNSYVSWFAHWGQGTLVTVSS

SEQ ID NO: 948 - protein, 109 aa, synthetic construct; identical to SEQ ID NO: 101

SEQ ID NO: 949 - protein, 125 aa, synthetic construct
EVQLLESGGGIVQPGGSLKLSCAASGFTFNTYAMNWVRQAPGKGLEWVARIRSKYNNYATYYKDSVKDRFTISRDDSKNTVYLQMNNLKTEDTAVYYCVRHENFGNSYVSWFAHWGQGTLVTVSS

SEQ ID NO: 950 - protein, 109 aa, synthetic construct; identical to SEQ ID NO: 101

SEQ ID NO: 951 - protein, 125 aa, synthetic construct
EVQLLESGGGIVQPGGSLKLSCAASGFTFNTYAMNWVRQAPGKGLEWVARIRSKYNNYATYYPDSVKDRFTISRDDSKNTVYLQMNNLKTEDTAVYYCVRHENFGNSYVSWFAHWGQGTLVTVSS

SEQ ID NO: 952 - protein, 109 aa, synthetic construct; identical to SEQ ID NO: 101

SEQ ID NO: 953 - protein, 125 aa, synthetic construct
EVQLLESGGGIVQPGGSLKLSCAASGFTFNTYAMNWVRQAPGKGLEWVARIRSKYNNYATYYADSVKGRFTISRDDSKNTVYLQMNNLKTEDTAVYYCVRHENFGNSYVSWFAHWGQGTLVTVSS

SEQ ID NO: 954 - protein, 109 aa, synthetic construct; identical to SEQ ID NO: 101

SEQ ID NO: 955 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVDLQMNNLKTEDTAVYYCVRHENFGNSYVSWFAHWGQGTLVTVSS

SEQ ID NO: 956 - protein, 109 aa, synthetic construct; identical to SEQ ID NO: 101

SEQ ID NO: 957 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVGLQMNNLKTEDTAVYYCVRHENFGNSYVSWFAHWGQGTLVTVSS

SEQ ID NO: 958 - protein, 109 aa, synthetic construct; identical to SEQ ID NO: 101

SEQ ID NO: 959 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVSLQMNNLKTEDTAVYYCVRHENFGNSYVSWFAHWGQGTLVTVSS

SEQ ID NO: 960 - protein, 109 aa, synthetic construct; identical to SEQ ID NO: 101

SEQ ID NO: 961 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVYLQMNELKTEDTAVYYCVRHENFGNSYVSWFAHWGQGTLVTVSS

SEQ ID NO: 962 - protein, 109 aa, synthetic construct; identical to SEQ ID NO: 101

SEQ ID NO: 963 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVYLQMNQLKTEDTAVYYCVRHENFGNSYVSWFAHWGQGTLVTVSS

SEQ ID NO: 964 - protein, 109 aa, synthetic construct; identical to SEQ ID NO: 101

SEQ ID NO: 965 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVYLQMNSLKTEDTAVYYCVRHENFGNSYVSWFAHWGQGTLVTVSS

SEQ ID NO: 966 - protein, 109 aa, synthetic construct; identical to SEQ ID NO: 101

SEQ ID NO: 967 - protein, 125 aa, synthetic construct
EVQLLESGGGIVQPGGSLKLSCAASGFTFNTYAMNWVRQAPGKGLEWVARIRSKYNNYATYYADSVKDRFTISRDDSKNTVYLQMNYLKTEDTAVYYCVRHENFGNSYVSWFAHWGQGTLVTVSS

SEQ ID NO: 968 - protein, 109 aa, synthetic construct; identical to SEQ ID NO: 101

SEQ ID NO: 969 - protein, 125 aa, synthetic construct; identical to SEQ ID NO: 831

SEQ ID NO: 970 - protein, 109 aa, synthetic construct
ELVVTQEPSLTVSPGGTVTLTCRSSNGAVTSSNYANWVQQKPGQAPRGLIGGTNKRAPGTPARFSGSLQGGKAALTLSGVQPEDEAVYYCALWYPNLWVFGGGTKLTVL

SEQ ID NO: 971 - protein, 125 aa, synthetic construct; identical to SEQ ID NO: 102

SEQ ID NO: 972 - protein, 109 aa, synthetic construct; identical to SEQ ID NO: 127

SEQ ID NO: 973 - protein, 125 aa, synthetic construct; identical to SEQ ID NO: 102

SEQ ID NO: 974 - protein, 109 aa, synthetic construct
ELVVTQEPSLTVSPGGTVTLTCRSSNGAVTSSNYANWVQQKPGQAPRGLIGGTNKRAPGTPARFSGSLDGGKAALTLSGVQPEDEAVYYCALWYPNLWVFGGGTKLTVL

SEQ ID NO: 975 - protein, 125 aa, synthetic construct; identical to SEQ ID NO: 102

SEQ ID NO: 976 - protein, 109 aa, synthetic construct; identical to SEQ ID NO: 104

SEQ ID NO: 977 - protein, 125 aa, synthetic construct; identical to SEQ ID NO: 102

SEQ ID NO: 978 - protein, 109 aa, synthetic construct
ELVVTQEPSLTVSPGGTVTLTCRSSNGAVTSSNYANWVQQKPGQAPRGLIGGTNKRAPGTPARFSGSKLGGKAALTLSGVQPEDEAVYYCALWYPNLWVFGGGTKLTVL

SEQ ID NO: 979 - protein, 125 aa, synthetic construct; identical to SEQ ID NO: 102

SEQ ID NO: 980 - protein, 109 aa, synthetic construct
ELVVTQEPSLTVSPGGTVTLTCRSSNGAVTSSNYANWVQQKPGQAPRGLIGGTNKRAPGTPARFSGSNLGGKAALTLSGVQPEDEAVYYCALWYPNLWVFGGGTKLTVL

SEQ ID NO: 981 - protein, 125 aa, synthetic construct; identical to SEQ ID NO: 102

SEQ ID NO: 982 - protein, 109 aa, synthetic construct
ELVVTQEPSLTVSPGGTVTLTCRSSNGAVTSSNYANWVQQKPGQAPRGLIGGTNKRAPGTPARFSGSTLGGKAALTLSGVQPEDEAVYYCALWYPNLWVFGGGTKLTVL

SEQ ID NO: 983 - protein, 125 aa, synthetic construct; identical to SEQ ID NO: 102

SEQ ID NO: 984-999 - skipped (16 entries)

SEQ ID NO: 1000 - protein, 1453 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESDIQMTQSPSSLSASVGDRVTITCQASQDISNYLNWYQQKPGKAPKLLIYDASNLETGVPSRFSGSGSGTDFTFTISSLQPEDIATYYCQHFDHLPLAFGQGTKVEIKSESATPESGPGTSPGATPESGPGTSESATPQVQLQESGPGLVKPSETLSLTCTVSGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSSGGGGSELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNDYATYYADSVKGRFTISRDDSKNTLYLQMNSLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1001 - protein, 1453 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESDIQMTQSPSSLSASVGDRVTITCQASQDISNYLNWYQQKPGKAPKLLIYDASNLETGVPSRFSGSGSGTDFTFTISSLQPEDIATYYCQHFDHLPLAFGQGTKVEIKSESATPESGPGTSPGATPESGPGTSESATPQVQLQQWGAGLLKPSETLSLTCAVYGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSSGGGGSELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNDYATYYADSVKGRFTISRDDSKNTLYLQMNSLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1002 - protein, 1453 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESDIQMTQSPSSLSASVGDRVTITCQASQDISNYLNWYQQKPGKAPKLLIYDASNLETGVPSRFSGSGSGTDFTLTISSLQPEDFATYYCQHFDHLPLAFGQGTKVEIKSESATPESGPGTSPGATPESGPGTSESATPQVQLQQWGAGLLKPSETLSLTCAVYGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSSGGGGSELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNDYATYYADSVKGRFTISRDDSKNTLYLQMNSLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1003 - protein, 1453 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESDIQMTQSPSSLSASVGDRVTITCQASQDISNYLNWYQQKPGKAPKLLIYDASNLETGVPSRFSGSGSGTDFTLTISSLQPEDFATYYCQHFDHLPLAFGQGTKVEIKSESATPESGPGTSPGATPESGPGTSESATPQVQLQESGPGLVKPSETLSLTCTVSGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSSGGGGSELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNDYATYYADSVKGRFTISRDDSKNTLYLQMNSLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1004 - protein, 1453 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESEIVLTQSPGTLSLSPGERATLSCQASQDISNYLNWYQQKPGQAPRLLIYDASNLETGIPDRFSGSGSGTDFTLTISRLEPEDFAVYYCQHFDHLPLAFGQGTKVEIKSESATPESGPGTSPGATPESGPGTSESATPQVQLQQWGAGLLKPSETLSLTCAVYGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSSGGGGSELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNDYATYYADSVKGRFTISRDDSKNTLYLQMNSLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1005 - protein, 1453 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESEIVLTQSPGTLSLSPGERATLSCQASQDISNYLNWYQQKPGQAPRLLIYDASNLETGIPDRFSGSGSGTDFTLTISRLEPEDFAVYYCQHFDHLPLAFGQGTKVEIKSESATPESGPGTSPGATPESGPGTSESATPQVQLQESGPGLVKPSETLSLTCTVSGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSSGGGGSELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNDYATYYADSVKGRFTISRDDSKNTLYLQMNSLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1006 - protein, 1453 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESEIVLTQSPATLSLSPGERATLSCQASQDISNYLNWYQQKPGQAPRLLIYDASNLETGIPARFSGSGSGTDFTLTISSLEPEDFAVYYCQHFDHLPLAFGQGTKVEIKSESATPESGPGTSPGATPESGPGTSESATPQVQLQQWGAGLLKPSETLSLTCAVYGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSSGGGGSELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNDYATYYADSVKGRFTISRDDSKNTLYLQMNSLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1007 - protein, 1453 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPEAGRSASHTPAGLTGPGTSESATPESEIVLTQSPATLSLSPGERATLSCQASQDISNYLNWYQQKPGQAPRLLIYDASNLETGIPARFSGSGSGTDFTLTISSLEPEDFAVYYCQHFDHLPLAFGQGTKVEIKSESATPESGPGTSPGATPESGPGTSESATPQVQLQESGPGLVKPSETLSLTCTVSGGSVSSGDYYWTWIRQPPGKGLEWIGHIYYSGNTNYNPSLKSRVTISVDTSKNQFSLKLSSVTAADTAVYYCARDRVTGAFDIWGQGTLVTVSSGGGGSELVVTQEPSLTVSPGGTVTLTCRSSNGAVTSSNYANWVQQKPGQAPRGLIGGTNKRAPGTPARFSGSLLEGKAALTLSGVQPEDEAVYYCALWYPNLWVFGGGTKLTVLSESATPESGPGTSPGATPESGPGTSESATPEVQLVESGGGIVQPGGSLRLSCAASGFTFSTYAMNWVRQAPGKGLEWVGRIRTKRNDYATYYADSVKGRFTISRDDSKNTLYLQMNSLKTEDTAVYYCVRHENFGNSYVSWFAHWGQGTLVTVSSGTATPESGPGEAGRSASHTPAGLTGPATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 1008-1009 - skipped (2 entries)

SEQ ID NO: 1010 - protein, 12 aa, synthetic construct
SGPGTGTSATPE

SEQ ID NO: 1011 - protein, 12 aa, synthetic construct
SGPGTTPGTTPE

SEQ ID NO: 1012 - protein, 12 aa, synthetic construct
SGPGTPPTSTPE

SEQ ID NO: 1013 - protein, 12 aa, synthetic construct
SGPGTGSAGTPE

SEQ ID NO: 1014 - protein, 12 aa, synthetic construct
SGPGTGGAGTPE

SEQ ID NO: 1015 - protein, 12 aa, synthetic construct
SGPGTSPGATPE

SEQ ID NO: 1016 - protein, 12 aa, synthetic construct
SGPGTSGSGTPE

SEQ ID NO: 1017 - protein, 12 aa, synthetic construct
SGPGTSSASTPE

SEQ ID NO: 1018 - protein, 12 aa, synthetic construct
SGPGTGAGTTPE

SEQ ID NO: 1019 - protein, 12 aa, synthetic construct
SGPGTGSTSTPE

SEQ ID NO: 1020 - protein, 12 aa, synthetic construct
TPGSEPATSGSE

SEQ ID NO: 1021 - protein, 12 aa, synthetic construct
GSAPGTSTEPSE

SEQ ID NO: 1022 - protein, 12 aa, synthetic construct
SGPGTAGSGTPE

SEQ ID NO: 1023 - protein, 12 aa, synthetic construct
SGPGTSSGGTPE

SEQ ID NO: 1024 - protein, 12 aa, synthetic construct
SGPGTAGPATPE

SEQ ID NO: 1025 - protein, 12 aa, synthetic construct
SGPGTPGTGTPE

SEQ ID NO: 1026 - protein, 12 aa, synthetic construct
SGPGTGGPTTPE

SEQ ID NO: 1027 - protein, 12 aa, synthetic construct
SGPGTGSGSTPE

SEQ ID NO: 1028-1714 - skipped (687 entries)

SEQ ID NO: 1715 - protein, 12 aa, synthetic construct
GSGASEPTSTEP

SEQ ID NO: 1716 - protein, 12 aa, synthetic construct
GSEPATSGTEPS

SEQ ID NO: 1717 - protein, 12 aa, synthetic construct
GTSEPSTSEPGA

SEQ ID NO: 1718 - protein, 12 aa, synthetic construct
GTSTEPSEPGSA

SEQ ID NO: 1719 - protein, 12 aa, synthetic construct
GSTAGSETSTEA

SEQ ID NO: 1720 - protein, 12 aa, synthetic construct
GSETATSGSETA

SEQ ID NO: 1721 - protein, 12 aa, synthetic construct
GTSESATSESGA

SEQ ID NO: 1722 - protein, 12 aa, synthetic construct
GTSTEASEGSAS

SEQ ID NO: 1723-7000 - skipped (5278 entries)

SEQ ID NO: 7001 - protein, 16 aa, synthetic construct
EAGRSANHEPLGLVAT

SEQ ID NO: 7002 - protein, 16 aa, synthetic construct
ASGRSTNAGPSGLAGP

SEQ ID NO: 7003 - protein, 16 aa, synthetic construct
ASGRSTNAGPQGLAGQ

SEQ ID NO: 7004 - protein, 16 aa, synthetic construct
ASGRSTNAGPPGLTGP

SEQ ID NO: 7005 - protein, 16 aa, synthetic construct
ASSRGTNAGPAGLTGP

SEQ ID NO: 7006 - protein, 16 aa, synthetic construct
ASSRTTNTGPSTLTGP

SEQ ID NO: 7007 - protein, 16 aa, synthetic construct
AAGRSDNGTPLELVAP

SEQ ID NO: 7008 - protein, 16 aa, synthetic construct
EAGRSANHEPLGLVAT

SEQ ID NO: 7009 - protein, 16 aa, synthetic construct
ASGRGTNAGPAGLTGP

SEQ ID NO: 7010 - protein, 16 aa, synthetic construct
LFGRNDNHEPLELGGG

SEQ ID NO: 7011 - protein, 16 aa, synthetic construct
TAGRSDNLEPLGLVFG

SEQ ID NO: 7012 - protein, 16 aa, synthetic construct
LDGRSDNFHPPELVAG

SEQ ID NO: 7013 - protein, 16 aa, synthetic construct
LEGRSDNEEPENLVAG

SEQ ID NO: 7014 - protein, 16 aa, synthetic construct
LKGRSDNNAPLALVAG

SEQ ID NO: 7015 - protein, 16 aa, synthetic construct
VYSRGTNAGPHGLTGR

SEQ ID NO: 7016 - protein, 16 aa, synthetic construct
ANSRGTNKGFAGLIGP

SEQ ID NO: 7017 - protein, 16 aa, synthetic construct
ASSRLTNEAPAGLTIP

SEQ ID NO: 7018 - protein, 16 aa, synthetic construct
DQSRGTNAGPEGLTDP

SEQ ID NO: 7019 - protein, 16 aa, synthetic construct
ESSRGTNIGQGGLTGP

SEQ ID NO: 7020 - protein, 16 aa, synthetic construct
SSSRGTNQDPAGLTIP

SEQ ID NO: 7021 - protein, 16 aa, synthetic construct
ASSRGQNHSPMGLTGP

SEQ ID NO: 7022 - protein, 16 aa, synthetic construct
AYSRGPNAGPAGLEGR

SEQ ID NO: 7023 - protein, 16 aa, synthetic construct
ASERGNNAGPANLTGF

SEQ ID NO: 7024 - protein, 16 aa, synthetic construct
ASHRGTNPKPAILTGP

SEQ ID NO: 7025 - protein, 16 aa, synthetic construct
MSSRRTNANPAQLTGP

SEQ ID NO: 7026 - protein, 16 aa, synthetic construct
GAGRTDNHEPLELGAA

SEQ ID NO: 7027 - protein, 16 aa, synthetic construct
LAGRSENTAPLELTAG

SEQ ID NO: 7028 - protein, 16 aa, synthetic construct
LEGRPDNHEPLALVAS

SEQ ID NO: 7029 - protein, 16 aa, synthetic construct
LSGRSDNEEPLALPAG

SEQ ID NO: 7030 - protein, 16 aa, synthetic construct
EAGRTDNHEPLELSAP

SEQ ID NO: 7031 - protein, 16 aa, synthetic construct
EGGRSDNHGPLELVSG

SEQ ID NO: 7032 - protein, 16 aa, synthetic construct
LSGRSDNEAPLELEAG

SEQ ID NO: 7033 - protein, 16 aa, synthetic construct
LGGRADNHEPPELGAG

SEQ ID NO: 7034 - protein, 16 aa, synthetic construct
PPSRGTNAEPAGLTGE

SEQ ID NO: 7035 - protein, 16 aa, synthetic construct
ASTRGENAGPAGLEAP

SEQ ID NO: 7036 - protein, 16 aa, synthetic construct
ESSRGTNGAPEGLTGP

SEQ ID NO: 7037 - protein, 16 aa, synthetic construct
ASSRATNESPAGLTGE

SEQ ID NO: 7038 - protein, 16 aa, synthetic construct
ASSRGENPPPGGLTGP

SEQ ID NO: 7039 - protein, 16 aa, synthetic construct
AASRGTNTGPAELTGS

SEQ ID NO: 7040 - protein, 16 aa, synthetic construct
AGSRTTNAGPGGLEGP

SEQ ID NO: 7041 - protein, 16 aa, synthetic construct
APSRGENAGPATLTGA

SEQ ID NO: 7042 - protein, 16 aa, synthetic construct
ESGRAANTGPPTLTAP

SEQ ID NO: 7043 - protein, 16 aa, synthetic construct
NPGRAANEGPPGLPGS

SEQ ID NO: 7044 - protein, 16 aa, synthetic construct
ESSRAANLTPPELTGP

SEQ ID NO: 7045 - protein, 16 aa, synthetic construct
ASGRAANETPPGLTGA

SEQ ID NO: 7046 - protein, 16 aa, synthetic construct
NSGRGENLGAPGLTGT

SEQ ID NO: 7047 - protein, 16 aa, synthetic construct
TTGRAANLTPAGLTGP

SEQ ID NO: 7048 - protein, 16 aa, synthetic construct
EAGRSANHTPAGLTGP

SEQ ID NO: 7049 - protein, 16 aa, synthetic construct
ESGRAANTTPAGLTGP

SEQ ID NO: 7050 - protein, 19 aa, synthetic construct
TTGRATEAANLTPAGLTGP

SEQ ID NO: 7051 - protein, 19 aa, synthetic construct
TTGRAEEAANLTPAGLTGP

SEQ ID NO: 7052 - protein, 19 aa, synthetic construct
TTGRAGEAANLTPAGLTGP

SEQ ID NO: 7053 - protein, 19 aa, synthetic construct
TTGRATEAANATPAGLTGP

SEQ ID NO: 7054 - protein, 19 aa, synthetic construct
TTGRAGEAEGATSAGATGP

SEQ ID NO: 7055 - protein, 19 aa, synthetic construct
TTGEAGEAANATSAGATGP

SEQ ID NO: 7056 - protein, 19 aa, synthetic construct
TTGEAGEAAGLTPAGLTGP

SEQ ID NO: 7057 - protein, 19 aa, synthetic construct
TTGAAGEAANATPAGLTGP

SEQ ID NO: 7058 - protein, 19 aa, synthetic construct
TTGRAGEAAGLTPAGLTGP

SEQ ID NO: 7059 - protein, 19 aa, synthetic construct
TTGRAGEAANATSAGATGP

SEQ ID NO: 7060 - protein, 19 aa, synthetic construct
TTGEAGEAAGATSAGATGP

SEQ ID NO: 7061 - protein, 16 aa, synthetic construct
ESGRAANTEPPELGAG

SEQ ID NO: 7062 - protein, 16 aa, synthetic construct
ESGRAANTAPEGLTGP

SEQ ID NO: 7063 - protein, 16 aa, synthetic construct
EPGRAANHEPSGLTEG

SEQ ID NO: 7064 - protein, 19 aa, synthetic construct
ESGRAANHTGAPPGGLTGP

SEQ ID NO: 7065 - protein, 19 aa, synthetic construct
TTGRTGEGANATPGGLTGP

SEQ ID NO: 7066 - protein, 19 aa, synthetic construct
RTGRSGEAANETPEGLEGP

SEQ ID NO: 7067 - protein, 19 aa, synthetic construct
RTGRTGESANETPAGLGGP

SEQ ID NO: 7068 - protein, 19 aa, synthetic construct
STGRTGEPANETPAGLSGP

SEQ ID NO: 7069 - protein, 19 aa, synthetic construct
TTGRAGEPANATPTGLSGP

SEQ ID NO: 7070 - protein, 19 aa, synthetic construct
RTGRPGEGANATPTGLPGP

SEQ ID NO: 7071 - protein, 19 aa, synthetic construct
RTGRGGEAANATPSGLGGP

SEQ ID NO: 7072 - protein, 19 aa, synthetic construct
STGRSGESANATPGGLGGP

SEQ ID NO: 7073 - protein, 19 aa, synthetic construct
RTGRTGEEANATPAGLPGP

SEQ ID NO: 7074 - protein, 19 aa, synthetic construct
ATGRPGEPANTTPEGLEGP

SEQ ID NO: 7075 - protein, 19 aa, synthetic construct
STGRSGEPANATPGGLTGP

SEQ ID NO: 7076 - protein, 19 aa, synthetic construct
PTGRGGEGANTTPTGLPGP

SEQ ID NO: 7077 - protein, 19 aa, synthetic construct
PTGRSGEGANATPSGLTGP

SEQ ID NO: 7078 - protein, 19 aa, synthetic construct
TTGRASEGANSTPAPLTEP

SEQ ID NO: 7079 - protein, 19 aa, synthetic construct
TYGRAAEAANTTPAGLTAP

SEQ ID NO: 7080 - protein, 19 aa, synthetic construct
TTGRATEGANATPAELTEP

SEQ ID NO: 7081 - protein, 19 aa, synthetic construct
TVGRASEEANTTPASLTGP

SEQ ID NO: 7082 - protein, 19 aa, synthetic construct
TTGRAPEAANATPAPLTGP

SEQ ID NO: 7083 - protein, 19 aa, synthetic construct
TWGRATEPANATPAPLTSP

SEQ ID NO: 7084 - protein, 19 aa, synthetic construct
TVGRASESANATPAELTSP

SEQ ID NO: 7085 - protein, 19 aa, synthetic construct
TVGRAPEGANSTPAGLTGP

SEQ ID NO: 7086 - protein, 19 aa, synthetic construct
TWGRATEAPNLEPATLTTP

SEQ ID NO: 7087 - protein, 19 aa, synthetic construct
TTGRATEAPNLTPAPLTEP

SEQ ID NO: 7088 - protein, 19 aa, synthetic construct
TQGRATEAPNLSPAALTSP

SEQ ID NO: 7089 - protein, 19 aa, synthetic construct
TQGRAAEAPNLTPATLTAP

SEQ ID NO: 7090 - protein, 19 aa, synthetic construct
TSGRAPEATNLAPAPLTGP

SEQ ID NO: 7091 - protein, 19 aa, synthetic construct
TQGRAAEAANLTPAGLTEP

SEQ ID NO: 7092 - protein, 19 aa, synthetic construct
TTGRAGSAPNLPPTGLTTP

SEQ ID NO: 7093 - protein, 19 aa, synthetic construct
TTGRAGGAENLPPEGLTAP

SEQ ID NO: 7094 - protein, 19 aa, synthetic construct
TTSRAGTATNLTPEGLTAP

SEQ ID NO: 7095 - protein, 19 aa, synthetic construct
TTGRAGTATNLPPSGLTTP

SEQ ID NO: 7096 - protein, 19 aa, synthetic construct
TTARAGEAENLSPSGLTAP

SEQ ID NO: 7097 - protein, 19 aa, synthetic construct
TTGRAGGAGNLAPGGLTEP

SEQ ID NO: 7098 - protein, 19 aa, synthetic construct
TTGRAGTATNLPPEGLTGP

SEQ ID NO: 7099 - protein, 19 aa, synthetic construct
TTGRAGGAANLAPTGLTEP

SEQ ID NO: 7100 - protein, 19 aa, synthetic construct
TTGRAGTAENLAPSGLTTP

SEQ ID NO: 7101 - protein, 19 aa, synthetic construct
TTGRAGSATNLGPGGLTGP

SEQ ID NO: 7102 - protein, 19 aa, synthetic construct
TTARAGGAENLTPAGLTEP

SEQ ID NO: 7103 - protein, 19 aa, synthetic construct
TTARAGSAENLSPSGLTGP

SEQ ID NO: 7104 - protein, 19 aa, synthetic construct
TTARAGGAGNLAPEGLTTP

SEQ ID NO: 7105 - protein, 19 aa, synthetic construct
TTSRAGAAENLTPTGLTGP

SEQ ID NO: 7106 - protein, 19 aa, synthetic construct
TYGRTTTPGNEPPASLEAE

SEQ ID NO: 7107 - protein, 19 aa, synthetic construct
TYSRGESGPNEPPPGLTGP

SEQ ID NO: 7108 - protein, 19 aa, synthetic construct
AWGRTGASENETPAPLGGE

SEQ ID NO: 7109 - protein, 19 aa, synthetic construct
RWGRAETTPNTPPEGLETE

SEQ ID NO: 7110 - protein, 19 aa, synthetic construct
ESGRAANHTGAEPPELGAG

SEQ ID NO: 7111 - protein, 19 aa, synthetic construct
TTGRAGEAANLTPAGLTES

SEQ ID NO: 7112 - protein, 19 aa, synthetic construct
TTGRAGEAANLTPAALTES

SEQ ID NO: 7113 - protein, 19 aa, synthetic construct
TTGRAGEAANLTPAPLTES

SEQ ID NO: 7114 - protein, 19 aa, synthetic construct
TTGRAGEAANLTPEPLTES

SEQ ID NO: 7115 - protein, 19 aa, synthetic construct
TTGRAGEAANLTPAGLTGA

SEQ ID NO: 7116 - protein, 19 aa, synthetic construct
TTGRAGEAANLTPEGLTGA

SEQ ID NO: 7117 - protein, 19 aa, synthetic construct
TTGRAGEAANLTPEPLTGA

SEQ ID NO: 7118 - protein, 19 aa, synthetic construct
TTGRAGEAANLTPAGLTEA

SEQ ID NO: 7119 - protein, 19 aa, synthetic construct
TTGRAGEAANLTPEGLTEA

SEQ ID NO: 7120 - protein, 19 aa, synthetic construct
TTGRAGEAANLTPAPLTEA

SEQ ID NO: 7121 - protein, 19 aa, synthetic construct
TTGRAGEAANLTPEPLTEA

SEQ ID NO: 7122 - protein, 19 aa, synthetic construct
TTGRAGEAANLTPEPLTGP

SEQ ID NO: 7123 - protein, 19 aa, synthetic construct
TTGRAGEAANLTPAGLTGG

SEQ ID NO: 7124 - protein, 19 aa, synthetic construct
TTGRAGEAANLTPEGLTGG

SEQ ID NO: 7125 - protein, 19 aa, synthetic construct
TTGRAGEAANLTPEALTGG

SEQ ID NO: 7126 - protein, 19 aa, synthetic construct
TTGRAGEAANLTPEPLTGG

SEQ ID NO: 7127 - protein, 19 aa, synthetic construct
TTGRAGEAANLTPAGLTEG

SEQ ID NO: 7128 - protein, 19 aa, synthetic construct
TTGRAGEAANLTPEGLTEG

SEQ ID NO: 7129 - protein, 19 aa, synthetic construct
TTGRAGEAANLTPAPLTEG

SEQ ID NO: 7130 - protein, 19 aa, synthetic construct
TTGRAGEAANLTPEPLTEG

SEQ ID NO: 7131 - protein, 29 aa, synthetic construct
GSAPGSAGGYAELRMGGAIATSGSETPGT

SEQ ID NO: 7132 - protein, 29 aa, synthetic construct
GSAPGTGGGYAPLRMGGGAATSGSETPGT

SEQ ID NO: 7133 - protein, 29 aa, synthetic construct
GSAPGAEGGYAALRMGGEIATSGSETPGT

SEQ ID NO: 7134 - protein, 29 aa, synthetic construct
GSAPGGPGGYALLRMGGPAATSGSETPGT

SEQ ID NO: 7135 - protein, 29 aa, synthetic construct
GSAPGEAGGYAFLRMGGSIATSGSETPGT

SEQ ID NO: 7136 - protein, 29 aa, synthetic construct
GSAPGPGGGYASLRMGGTAATSGSETPGT

SEQ ID NO: 7137 - protein, 29 aa, synthetic construct
GSAPGSEGGYATLRMGGAIATSGSETPGT

SEQ ID NO: 7138 - protein, 29 aa, synthetic construct
GSAPGTPGGYANLRMGGGAATSGSETPGT

SEQ ID NO: 7139 - protein, 29 aa, synthetic construct
GSAPGASGGYAHLRMGGEIATSGSETPGT

SEQ ID NO: 7140 - protein, 29 aa, synthetic construct
GSAPGGTGGYGELRMGGPAATSGSETPGT

SEQ ID NO: 7141 - protein, 29 aa, synthetic construct
GSAPGEAGGYPELRMGGSIATSGSETPGT

SEQ ID NO: 7142 - protein, 29 aa, synthetic construct
GSAPGPGGGYVELRMGGTAATSGSETPGT

SEQ ID NO: 7143 - protein, 29 aa, synthetic construct
GSAPGSEGGYLELRMGGAIATSGSETPGT

SEQ ID NO: 7144 - protein, 29 aa, synthetic construct
GSAPGTPGGYSELRMGGGAATSGSETPGT

SEQ ID NO: 7145 - protein, 29 aa, synthetic construct
GSAPGASGGYTELRMGGEIATSGSETPGT

SEQ ID NO: 7146 - protein, 29 aa, synthetic construct
GSAPGGTGGYQELRMGGPAATSGSETPGT

SEQ ID NO: 7147 - protein, 29 aa, synthetic construct
GSAPGEAGGYEELRMGGSIATSGSETPGT

SEQ ID NO: 7148 - protein, 29 aa, synthetic construct
GSAPGPGIGPAELRMGGTAATSGSETPGT

SEQ ID NO: 7149 - protein, 29 aa, synthetic construct
GSAPGSEIGAAELRMGGAIATSGSETPGT

SEQ ID NO: 7150 - protein, 29 aa, synthetic construct
GSAPGTPIGSAELRMGGGAATSGSETPGT

SEQ ID NO: 7151 - protein, 29 aa, synthetic construct
GSAPGASIGTAELRMGGEIATSGSETPGT

SEQ ID NO: 7152 - protein, 29 aa, synthetic construct
GSAPGGTIGNAELRMGGPAATSGSETPGT

SEQ ID NO: 7153 - protein, 29 aa, synthetic construct
GSAPGEAIGQAELRMGGSIATSGSETPGT

SEQ ID NO: 7154 - protein, 29 aa, synthetic construct
GSAPGPGGPYAELRMGGTAATSGSETPGT

SEQ ID NO: 7155 - protein, 29 aa, synthetic construct
GSAPGSEGAYAELRMGGAIATSGSETPGT

SEQ ID NO: 7156 - protein, 29 aa, synthetic construct
GSAPGTPGVYAELRMGGGAATSGSETPGT

SEQ ID NO: 7157 - protein, 29 aa, synthetic construct
GSAPGASGLYAELRMGGEIATSGSETPGT

SEQ ID NO: 7158 - protein, 29 aa, synthetic construct
GSAPGGTGIYAELRMGGPAATSGSETPGT

SEQ ID NO: 7159 - protein, 29 aa, synthetic construct
GSAPGEAGFYAELRMGGSIATSGSETPGT

SEQ ID NO: 7160 - protein, 29 aa, synthetic construct
GSAPGPGGYYAELRMGGTAATSGSETPGT

SEQ ID NO: 7161 - protein, 29 aa, synthetic construct
GSAPGSEGSYAELRMGGAIATSGSETPGT

SEQ ID NO: 7162 - protein, 29 aa, synthetic construct
GSAPGTPGNYAELRMGGGAATSGSETPGT

SEQ ID NO: 7163 - protein, 29 aa, synthetic construct
GSAPGASGEYAELRMGGEIATSGSETPGT

SEQ ID NO: 7164 - protein, 29 aa, synthetic construct
GSAPGGTGHYAELRMGGPAATSGSETPGT

SEQ ID NO: 7165 - protein, 29 aa, synthetic construct
GSAPGEAGGYAEARMGGSIATSGSETPGT

SEQ ID NO: 7166 - protein, 29 aa, synthetic construct
GSAPGPGGGYAEVRMGGTAATSGSETPGT

SEQ ID NO: 7167 - protein, 29 aa, synthetic construct
GSAPGSEGGYAEIRMGGAIATSGSETPGT

SEQ ID NO: 7168 - protein, 29 aa, synthetic construct
GSAPGTPGGYAEFRMGGGAATSGSETPGT

SEQ ID NO: 7169 - protein, 29 aa, synthetic construct
GSAPGASGGYAEYRMGGEIATSGSETPGT

SEQ ID NO: 7170 - protein, 29 aa, synthetic construct
GSAPGGTGGYAESRMGGPAATSGSETPGT

SEQ ID NO: 7171 - protein, 29 aa, synthetic construct
GSAPGEAGGYAETRMGGSIATSGSETPGT

SEQ ID NO: 7172 - protein, 29 aa, synthetic construct
GSAPGPGGGYAELAMGGTRATSGSETPGT

SEQ ID NO: 7173 - protein, 29 aa, synthetic construct
GSAPGSEGGYAELVMGGARATSGSETPGT

SEQ ID NO: 7174 - protein, 29 aa, synthetic construct
GSAPGTPGGYAELLMGGGRATSGSETPGT

SEQ ID NO: 7175 - protein, 29 aa, synthetic construct
GSAPGASGGYAELIMGGERATSGSETPGT

SEQ ID NO: 7176 - protein, 29 aa, synthetic construct
GSAPGGTGGYAELWMGGPRATSGSETPGT

SEQ ID NO: 7177 - protein, 29 aa, synthetic construct
GSAPGEAGGYAELSMGGSRATSGSETPGT

SEQ ID NO: 7178 - protein, 29 aa, synthetic construct
GSAPGPGGGYAELTMGGTRATSGSETPGT

SEQ ID NO: 7179 - protein, 29 aa, synthetic construct
GSAPGSEGGYAELQMGGARATSGSETPGT

SEQ ID NO: 7180 - protein, 29 aa, synthetic construct
GSAPGTPGGYAELNMGGGRATSGSETPGT

SEQ ID NO: 7181 - protein, 29 aa, synthetic construct
GSAPGASGGYAELEMGGERATSGSETPGT

SEQ ID NO: 7182 - protein, 29 aa, synthetic construct
GSAPGGTGGYAELRPGGPIATSGSETPGT

SEQ ID NO: 7183 - protein, 29 aa, synthetic construct
GSAPGEAGGYAELRAGGSAATSGSETPGT

SEQ ID NO: 7184 - protein, 29 aa, synthetic construct
GSAPGPGGGYAELRLGGTIATSGSETPGT

SEQ ID NO: 7185 - protein, 29 aa, synthetic construct
GSAPGSEGGYAELRIGGAAATSGSETPGT

SEQ ID NO: 7186 - protein, 29 aa, synthetic construct
GSAPGTPGGYAELRSGGGIATSGSETPGT

SEQ ID NO: 7187 - protein, 29 aa, synthetic construct
GSAPGASGGYAELRNGGEAATSGSETPGT

SEQ ID NO: 7188 - protein, 29 aa, synthetic construct
GSAPGGTGGYAELRQGGPIATSGSETPGT

SEQ ID NO: 7189 - protein, 29 aa, synthetic construct
GSAPGEAGGYAELRDGGSAATSGSETPGT

SEQ ID NO: 7190 - protein, 29 aa, synthetic construct
GSAPGPGGGYAELREGGTIATSGSETPGT

SEQ ID NO: 7191 - protein, 29 aa, synthetic construct
GSAPGSEGGYAELRHGGAAATSGSETPGT

SEQ ID NO: 7192 - protein, 29 aa, synthetic construct
GSAPGTPGGYAELRMPGGIATSGSETPGT

SEQ ID NO: 7193 - protein, 29 aa, synthetic construct
GSAPGASGGYAELRMAGEAATSGSETPGT

SEQ ID NO: 7194 - protein, 29 aa, synthetic construct
GSAPGGTGGYAELRMVGPIATSGSETPGT

SEQ ID NO: 7195 - protein, 29 aa, synthetic construct
GSAPGEAGGYAELRMLGSAATSGSETPGT

SEQ ID NO: 7196 - protein, 29 aa, synthetic construct
GSAPGPGGGYAELRMIGTIATSGSETPGT

SEQ ID NO: 7197 - protein, 29 aa, synthetic construct
GSAPGSEGGYAELRMYGAIATSGSETPGT

SEQ ID NO: 7198 - protein, 29 aa, synthetic construct
GSAPGTPGGYAELRMSGGAATSGSETPGT

SEQ ID NO: 7199 - protein, 29 aa, synthetic construct
GSAPGASGGYAELRMNGEIATSGSETPGT

SEQ ID NO: 7200 - protein, 29 aa, synthetic construct
GSAPGGTGGYAELRMQGPAATSGSETPGT

SEQ ID NO: 7201 - protein, 29 aa, synthetic construct
GSAPGANHTPAGLTGPGARATSGSETPGT

SEQ ID NO: 7202 - protein, 29 aa, synthetic construct
GSAPGANTAPEGLTGPSTRATSGSETPGT

SEQ ID NO: 7203 - protein, 29 aa, synthetic construct
GSAPGTGAPPGGLTGPGTRATSGSETPGT

SEQ ID NO: 7204 - protein, 29 aa, synthetic construct
GSAPGANHEPSGLTEGSPRATSGSETPGT

SEQ ID NO: 7205 - protein, 29 aa, synthetic construct
GSAPGANTEPPELGAGTERATSGSETPGT

SEQ ID NO: 7206 - protein, 29 aa, synthetic construct
GSAPGASGPPPGLTGPPGRATSGSETPGT

SEQ ID NO: 7207 - protein, 29 aa, synthetic construct
GSAPGASGTPAPLGGEPGRATSGSETPGT

SEQ ID NO: 7208 - protein, 29 aa, synthetic construct
GSAPGPAGPPEGLETEAGRATSGSETPGT

SEQ ID NO: 7209 - protein, 29 aa, synthetic construct
GSAPGPTSGQGGLTGPESRATSGSETPGT

SEQ ID NO: 7210 - protein, 29 aa, synthetic construct
GSAPGSAGGAANLVRGGAIATSGSETPGT

SEQ ID NO: 7211 - protein, 29 aa, synthetic construct
GSAPGTGGGAAPLVRGGGAATSGSETPGT

SEQ ID NO: 7212 - protein, 29 aa, synthetic construct
GSAPGAEGGAAALVRGGEIATSGSETPGT

SEQ ID NO: 7213 - protein, 29 aa, synthetic construct
GSAPGGPGGAALLVRGGPAATSGSETPGT

SEQ ID NO: 7214 - protein, 29 aa, synthetic construct
GSAPGEAGGAAFLVRGGSIATSGSETPGT

SEQ ID NO: 7215 - protein, 29 aa, synthetic construct
GSAPGPGGGAASLVRGGTAATSGSETPGT

SEQ ID NO: 7216 - protein, 29 aa, synthetic construct
GSAPGSEGGAATLVRGGAIATSGSETPGT

SEQ ID NO: 7217 - protein, 29 aa, synthetic construct
GSAPGTPGGAAGLVRGGGAATSGSETPGT

SEQ ID NO: 7218 - protein, 29 aa, synthetic construct
GSAPGASGGAADLVRGGEIATSGSETPGT

SEQ ID NO: 7219 - protein, 29 aa, synthetic construct
GSAPGGTGGAGNLVRGGPAATSGSETPGT

SEQ ID NO: 7220 - protein, 29 aa, synthetic construct
GSAPGEAGGAPNLVRGGSIATSGSETPGT

SEQ ID NO: 7221 - protein, 29 aa, synthetic construct
GSAPGPGGGAVNLVRGGTAATSGSETPGT

SEQ ID NO: 7222 - protein, 29 aa, synthetic construct
GSAPGSEGGALNLVRGGAIATSGSETPGT

SEQ ID NO: 7223 - protein, 29 aa, synthetic construct
GSAPGTPGGASNLVRGGGAATSGSETPGT

SEQ ID NO: 7224 - protein, 29 aa, synthetic construct
GSAPGASGGATNLVRGGEIATSGSETPGT

SEQ ID NO: 7225 - protein, 29 aa, synthetic construct
GSAPGGTGGAQNLVRGGPAATSGSETPGT

SEQ ID NO: 7226 - protein, 29 aa, synthetic construct
GSAPGEAGGAENLVRGGSIATSGSETPGT

SEQ ID NO: 7227 - protein, 30 aa, synthetic construct
GSAPEAGRSANHEPLGLVATATSGSETPGT

SEQ ID NO: 7228 - protein, 30 aa, synthetic construct
GSAPASGRSTNAGPSGLAGPATSGSETPGT

SEQ ID NO: 7229 - protein, 30 aa, synthetic construct
GSAPASGRSTNAGPQGLAGQATSGSETPGT

SEQ ID NO: 7230 - protein, 30 aa, synthetic construct
GSAPASGRSTNAGPPGLTGPATSGSETPGT

SEQ ID NO: 7231 - protein, 30 aa, synthetic construct
GSAPASSRGTNAGPAGLTGPATSGSETPGT

SEQ ID NO: 7232 - protein, 30 aa, synthetic construct
GSAPASSRTTNTGPSTLTGPATSGSETPGT

SEQ ID NO: 7233 - protein, 30 aa, synthetic construct
GSAPAAGRSDNGTPLELVAPATSGSETPGT

SEQ ID NO: 7234 - protein, 30 aa, synthetic construct; identical to SEQ ID NO: 7227

SEQ ID NO: 7235 - protein, 30 aa, synthetic construct
GSAPASGRGTNAGPAGLTGPATSGSETPGT

SEQ ID NO: 7236 - protein, 30 aa, synthetic construct
GSAPLFGRNDNHEPLELGGGATSGSETPGT

SEQ ID NO: 7237 - protein, 30 aa, synthetic construct
GSAPTAGRSDNLEPLGLVFGATSGSETPGT

SEQ ID NO: 7238 - protein, 30 aa, synthetic construct
GSAPLDGRSDNFHPPELVAGATSGSETPGT

SEQ ID NO: 7239 - protein, 30 aa, synthetic construct
GSAPLEGRSDNEEPENLVAGATSGSETPGT

SEQ ID NO: 7240 - protein, 30 aa, synthetic construct
GSAPLKGRSDNNAPLALVAGATSGSETPGT

SEQ ID NO: 7241 - protein, 30 aa, synthetic construct
GSAPVYSRGTNAGPHGLTGRATSGSETPGT

SEQ ID NO: 7242 - protein, 30 aa, synthetic construct
GSAPANSRGTNKGFAGLIGPATSGSETPGT

SEQ ID NO: 7243 - protein, 30 aa, synthetic construct
GSAPASSRLTNEAPAGLTIPATSGSETPGT

SEQ ID NO: 7244 - protein, 30 aa, synthetic construct
GSAPDQSRGTNAGPEGLTDPATSGSETPGT

SEQ ID NO: 7245 - protein, 30 aa, synthetic construct
GSAPESSRGTNIGQGGLTGPATSGSETPGT

SEQ ID NO: 7246 - protein, 30 aa, synthetic construct
GSAPSSSRGTNQDPAGLTIPATSGSETPGT

SEQ ID NO: 7247 - protein, 30 aa, synthetic construct
GSAPASSRGQNHSPMGLTGPATSGSETPGT

SEQ ID NO: 7248 - protein, 30 aa, synthetic construct
GSAPAYSRGPNAGPAGLEGRATSGSETPGT

SEQ ID NO: 7249 - protein, 30 aa, synthetic construct
GSAPASERGNNAGPANLTGFATSGSETPGT

SEQ ID NO: 7250 - protein, 30 aa, synthetic construct
GSAPASHRGTNPKPAILTGPATSGSETPGT

SEQ ID NO: 7251 - protein, 30 aa, synthetic construct
GSAPMSSRRTNANPAQLTGPATSGSETPGT

SEQ ID NO: 7252 - protein, 30 aa, synthetic construct
GSAPGAGRTDNHEPLELGAAATSGSETPGT

SEQ ID NO: 7253 - protein, 30 aa, synthetic construct
GSAPLAGRSENTAPLELTAGATSGSETPGT

SEQ ID NO: 7254 - protein, 30 aa, synthetic construct
GSAPLEGRPDNHEPLALVASATSGSETPGT

SEQ ID NO: 7255 - protein, 30 aa, synthetic construct
GSAPLSGRSDNEEPLALPAGATSGSETPGT

SEQ ID NO: 7256 - protein, 30 aa, synthetic construct
GSAPEAGRTDNHEPLELSAPATSGSETPGT

SEQ ID NO: 7257 - protein, 30 aa, synthetic construct
GSAPEGGRSDNHGPLELVSGATSGSETPGT

SEQ ID NO: 7258 - protein, 30 aa, synthetic construct
GSAPLSGRSDNEAPLELEAGATSGSETPGT

SEQ ID NO: 7259 - protein, 30 aa, synthetic construct
GSAPLGGRADNHEPPELGAGATSGSETPGT

SEQ ID NO: 7260 - protein, 30 aa, synthetic construct
GSAPPPSRGTNAEPAGLTGEATSGSETPGT

SEQ ID NO: 7261 - protein, 30 aa, synthetic construct
GSAPASTRGENAGPAGLEAPATSGSETPGT

SEQ ID NO: 7262 - protein, 30 aa, synthetic construct
GSAPESSRGTNGAPEGLTGPATSGSETPGT

SEQ ID NO: 7263 - protein, 30 aa, synthetic construct
GSAPASSRATNESPAGLTGEATSGSETPGT

SEQ ID NO: 7264 - protein, 30 aa, synthetic construct
GSAPASSRGENPPPGGLTGPATSGSETPGT

SEQ ID NO: 7265 - protein, 30 aa, synthetic construct
GSAPAASRGTNTGPAELTGSATSGSETPGT

SEQ ID NO: 7266 - protein, 30 aa, synthetic construct
GSAPAGSRTTNAGPGGLEGPATSGSETPGT

SEQ ID NO: 7267 - protein, 30 aa, synthetic construct
GSAPAPSRGENAGPATLTGAATSGSETPGT

SEQ ID NO: 7268 - protein, 30 aa, synthetic construct
GSAPESGRAANTGPPTLTAPATSGSETPGT

SEQ ID NO: 7269 - protein, 30 aa, synthetic construct
GSAPNPGRAANEGPPGLPGSATSGSETPGT

SEQ ID NO: 7270 - protein, 30 aa, synthetic construct
GSAPESSRAANLTPPELTGPATSGSETPGT

SEQ ID NO: 7271 - protein, 30 aa, synthetic construct
GSAPASGRAANETPPGLTGAATSGSETPGT

SEQ ID NO: 7272 - protein, 30 aa, synthetic construct
GSAPNSGRGENLGAPGLTGTATSGSETPGT

SEQ ID NO: 7273 - protein, 30 aa, synthetic construct
GSAPTTGRAANLTPAGLTGPATSGSETPGT

SEQ ID NO: 7274 - protein, 30 aa, synthetic construct
GSAPEAGRSANHTPAGLTGPATSGSETPGT

SEQ ID NO: 7275 - protein, 30 aa, synthetic construct
GSAPESGRAANTTPAGLTGPATSGSETPGT

SEQ ID NO: 7276 - protein, 33 aa, synthetic construct
GSAPTTGRATEAANLTPAGLTGPATSGSETPGT

SEQ ID NO: 7277 - protein, 33 aa, synthetic construct
GSAPTTGRAEEAANLTPAGLTGPATSGSETPGT

SEQ ID NO: 7278 - protein, 33 aa, synthetic construct
GSAPTTGRAGEAANLTPAGLTGPATSGSETPGT

SEQ ID NO: 7279 - protein, 33 aa, synthetic construct
GSAPTTGRATEAANATPAGLTGPATSGSETPGT

SEQ ID NO: 7280 - protein, 33 aa, synthetic construct
GSAPTTGRAGEAEGATSAGATGPATSGSETPGT

SEQ ID NO: 7281 - protein, 33 aa, synthetic construct
GSAPTTGEAGEAANATSAGATGPATSGSETPGT

SEQ ID NO: 7282 - protein, 33 aa, synthetic construct
GSAPTTGEAGEAAGLTPAGLTGPATSGSETPGT

SEQ ID NO: 7283 - protein, 33 aa, synthetic construct
GSAPTTGAAGEAANATPAGLTGPATSGSETPGT

SEQ ID NO: 7284 - protein, 33 aa, synthetic construct
GSAPTTGRAGEAAGLTPAGLTGPATSGSETPGT

SEQ ID NO: 7285 - protein, 33 aa, synthetic construct
GSAPTTGRAGEAANATSAGATGPATSGSETPGT

SEQ ID NO: 7286 - protein, 33 aa, synthetic construct
GSAPTTGEAGEAAGATSAGATGPATSGSETPGT

SEQ ID NO: 7287 - protein, 30 aa, synthetic construct
GSAPESGRAANTEPPELGAGATSGSETPGT

SEQ ID NO: 7288 - protein, 30 aa, synthetic construct
GSAPESGRAANTAPEGLTGPATSGSETPGT

SEQ ID NO: 7289 - protein, 30 aa, synthetic construct
GSAPEPGRAANHEPSGLTEGATSGSETPGT

SEQ ID NO: 7290 - protein, 33 aa, synthetic construct
GSAPESGRAANHTGAPPGGLTGPATSGSETPGT

SEQ ID NO: 7291 - protein, 33 aa, synthetic construct
GSAPTTGRTGEGANATPGGLTGPATSGSETPGT

SEQ ID NO: 7292 - protein, 33 aa, synthetic construct
GSAPRTGRSGEAANETPEGLEGPATSGSETPGT

SEQ ID NO: 7293 - protein, 33 aa, synthetic construct
GSAPRTGRTGESANETPAGLGGPATSGSETPGT

SEQ ID NO: 7294 - protein, 33 aa, synthetic construct
GSAPSTGRTGEPANETPAGLSGPATSGSETPGT

SEQ ID NO: 7295 - protein, 33 aa, synthetic construct
GSAPTTGRAGEPANATPTGLSGPATSGSETPGT

SEQ ID NO: 7296 - protein, 33 aa, synthetic construct
GSAPRTGRPGEGANATPTGLPGPATSGSETPGT

SEQ ID NO: 7297 - protein, 33 aa, synthetic construct
GSAPRTGRGGEAANATPSGLGGPATSGSETPGT

SEQ ID NO: 7298 - protein, 33 aa, synthetic construct
GSAPSTGRSGESANATPGGLGGPATSGSETPGT

SEQ ID NO: 7299 - protein, 33 aa, synthetic construct
GSAPRTGRTGEEANATPAGLPGPATSGSETPGT

SEQ ID NO: 7300 - protein, 33 aa, synthetic construct
GSAPATGRPGEPANTTPEGLEGPATSGSETPGT

SEQ ID NO: 7301 - protein, 33 aa, synthetic construct
GSAPSTGRSGEPANATPGGLTGPATSGSETPGT

SEQ ID NO: 7302 - protein, 33 aa, synthetic construct
GSAPPTGRGGEGANTTPTGLPGPATSGSETPGT

SEQ ID NO: 7303 - protein, 33 aa, synthetic construct
GSAPPTGRSGEGANATPSGLTGPATSGSETPGT

SEQ ID NO: 7304 - protein, 33 aa, synthetic construct
GSAPTTGRASEGANSTPAPLTEPATSGSETPGT

SEQ ID NO: 7305 - protein, 33 aa, synthetic construct
GSAPTYGRAAEAANTTPAGLTAPATSGSETPGT

SEQ ID NO: 7306 - protein, 33 aa, synthetic construct
GSAPTTGRATEGANATPAELTEPATSGSETPGT

SEQ ID NO: 7307 - protein, 33 aa, synthetic construct
GSAPTVGRASEEANTTPASLTGPATSGSETPGT

SEQ ID NO: 7308 - protein, 33 aa, synthetic construct
GSAPTTGRAPEAANATPAPLTGPATSGSETPGT

SEQ ID NO: 7309 - protein, 33 aa, synthetic construct
GSAPTWGRATEPANATPAPLTSPATSGSETPGT

SEQ ID NO: 7310 - protein, 33 aa, synthetic construct
GSAPTVGRASESANATPAELTSPATSGSETPGT

SEQ ID NO: 7311 - protein, 33 aa, synthetic construct
GSAPTVGRAPEGANSTPAGLTGPATSGSETPGT

SEQ ID NO: 7312 - protein, 33 aa, synthetic construct
GSAPTWGRATEAPNLEPATLTTPATSGSETPGT

SEQ ID NO: 7313 - protein, 33 aa, synthetic construct
GSAPTTGRATEAPNLTPAPLTEPATSGSETPGT

SEQ ID NO: 7314 - protein, 33 aa, synthetic construct
GSAPTQGRATEAPNLSPAALTSPATSGSETPGT

SEQ ID NO: 7315 - protein, 33 aa, synthetic construct
GSAPTQGRAAEAPNLTPATLTAPATSGSETPGT

SEQ ID NO: 7316 - protein, 33 aa, synthetic construct
GSAPTSGRAPEATNLAPAPLTGPATSGSETPGT

SEQ ID NO: 7317 - protein, 33 aa, synthetic construct
GSAPTQGRAAEAANLTPAGLTEPATSGSETPGT

SEQ ID NO: 7318 - protein, 33 aa, synthetic construct
GSAPTTGRAGSAPNLPPTGLTTPATSGSETPGT

SEQ ID NO: 7319 - protein, 33 aa, synthetic construct
GSAPTTGRAGGAENLPPEGLTAPATSGSETPGT

SEQ ID NO: 7320 - protein, 33 aa, synthetic construct
GSAPTTSRAGTATNLTPEGLTAPATSGSETPGT

SEQ ID NO: 7321 - protein, 33 aa, synthetic construct
GSAPTTGRAGTATNLPPSGLTTPATSGSETPGT

SEQ ID NO: 7322 - protein, 33 aa, synthetic construct
GSAPTTARAGEAENLSPSGLTAPATSGSETPGT

SEQ ID NO: 7323 - protein, 33 aa, synthetic construct
GSAPTTGRAGGAGNLAPGGLTEPATSGSETPGT

SEQ ID NO: 7324 - protein, 33 aa, synthetic construct
GSAPTTGRAGTATNLPPEGLTGPATSGSETPGT

SEQ ID NO: 7325 - protein, 33 aa, synthetic construct
GSAPTTGRAGGAANLAPTGLTEPATSGSETPGT

SEQ ID NO: 7326 - protein, 33 aa, synthetic construct
GSAPTTGRAGTAENLAPSGLTTPATSGSETPGT

SEQ ID NO: 7327 - protein, 33 aa, synthetic construct
GSAPTTGRAGSATNLGPGGLTGPATSGSETPGT

SEQ ID NO: 7328 - protein, 33 aa, synthetic construct
GSAPTTARAGGAENLTPAGLTEPATSGSETPGT

SEQ ID NO: 7329 - protein, 33 aa, synthetic construct
GSAPTTARAGSAENLSPSGLTGPATSGSETPGT

SEQ ID NO: 7330 - protein, 33 aa, synthetic construct
GSAPTTARAGGAGNLAPEGLTTPATSGSETPGT

SEQ ID NO: 7331 - protein, 33 aa, synthetic construct
GSAPTTSRAGAAENLTPTGLTGPATSGSETPGT

SEQ ID NO: 7332 - protein, 33 aa, synthetic construct
GSAPTYGRTTTPGNEPPASLEAEATSGSETPGT

SEQ ID NO: 7333 - protein, 33 aa, synthetic construct
GSAPTYSRGESGPNEPPPGLTGPATSGSETPGT

SEQ ID NO: 7334 - protein, 33 aa, synthetic construct
GSAPAWGRTGASENETPAPLGGEATSGSETPGT

SEQ ID NO: 7335 - protein, 33 aa, synthetic construct
GSAPRWGRAETTPNTPPEGLETEATSGSETPGT

SEQ ID NO: 7336 - protein, 33 aa, synthetic construct
GSAPESGRAANHTGAEPPELGAGATSGSETPGT

SEQ ID NO: 7337 - protein, 33 aa, synthetic construct
GSAPTTGRAGEAANLTPAGLTESATSGSETPGT

SEQ ID NO: 7338 - protein, 33 aa, synthetic construct
GSAPTTGRAGEAANLTPAALTESATSGSETPGT

SEQ ID NO: 7339 - protein, 33 aa, synthetic construct
GSAPTTGRAGEAANLTPAPLTESATSGSETPGT

SEQ ID NO: 7340 - protein, 33 aa, synthetic construct
GSAPTTGRAGEAANLTPEPLTESATSGSETPGT

SEQ ID NO: 7341 - protein, 33 aa, synthetic construct
GSAPTTGRAGEAANLTPAGLTGAATSGSETPGT

SEQ ID NO: 7342 - protein, 33 aa, synthetic construct
GSAPTTGRAGEAANLTPEGLTGAATSGSETPGT

SEQ ID NO: 7343 - protein, 33 aa, synthetic construct
GSAPTTGRAGEAANLTPEPLTGAATSGSETPGT

SEQ ID NO: 7344 - protein, 33 aa, synthetic construct
GSAPTTGRAGEAANLTPAGLTEAATSGSETPGT

SEQ ID NO: 7345 - protein, 33 aa, synthetic construct
GSAPTTGRAGEAANLTPEGLTEAATSGSETPGT

SEQ ID NO: 7346 - protein, 33 aa, synthetic construct
GSAPTTGRAGEAANLTPAPLTEAATSGSETPGT

SEQ ID NO: 7347 - protein, 33 aa, synthetic construct
GSAPTTGRAGEAANLTPEPLTEAATSGSETPGT

SEQ ID NO: 7348 - protein, 33 aa, synthetic construct
GSAPTTGRAGEAANLTPEPLTGPATSGSETPGT

SEQ ID NO: 7349 - protein, 33 aa, synthetic construct
GSAPTTGRAGEAANLTPAGLTGGATSGSETPGT

SEQ ID NO: 7350 - protein, 33 aa, synthetic construct
GSAPTTGRAGEAANLTPEGLTGGATSGSETPGT

SEQ ID NO: 7351 - protein, 33 aa, synthetic construct
GSAPTTGRAGEAANLTPEALTGGATSGSETPGT

SEQ ID NO: 7352 - protein, 33 aa, synthetic construct
GSAPTTGRAGEAANLTPEPLTGGATSGSETPGT

SEQ ID NO: 7353 - protein, 33 aa, synthetic construct
GSAPTTGRAGEAANLTPAGLTEGATSGSETPGT

SEQ ID NO: 7354 - protein, 33 aa, synthetic construct
GSAPTTGRAGEAANLTPEGLTEGATSGSETPGT

SEQ ID NO: 7355 - protein, 33 aa, synthetic construct
GSAPTTGRAGEAANLTPAPLTEGATSGSETPGT

SEQ ID NO: 7356 - protein, 33 aa, synthetic construct
GSAPTTGRAGEAANLTPEPLTEGATSGSETPGT

SEQ ID NO: 7357 - protein, 33 aa, synthetic construct; identical to SEQ ID NO: 7280

SEQ ID NO: 7358 - protein, 30 aa, synthetic construct
GSAPEAGRSAEATSAGATGPATSGSETPGT

SEQ ID NO: 7359 - protein, 30 aa, synthetic construct
GSAPSASGTYSRGESGPGSPATSGSETPGT

SEQ ID NO: 7360 - protein, 30 aa, synthetic construct
GSAPSASGEAGRTDTHPGSPATSGSETPGT

SEQ ID NO: 7361 - protein, 30 aa, synthetic construct
GSAPSASGEPGRAAEHPGSPATSGSETPGT

SEQ ID NO: 7362 - protein, 30 aa, synthetic construct
GSAPSPAGESSRGTTIAGSPATSGSETPGT

SEQ ID NO: 7363 - protein, 33 aa, synthetic construct; identical to SEQ ID NO: 7282

SEQ ID NO: 7364 - protein, 30 aa, synthetic construct
GSAPEAGESAGATPAGLTGPATSGSETPGT

SEQ ID NO: 7365 - protein, 30 aa, synthetic construct
GSAPSASGAPLELEAGPGSPATSGSETPGT

SEQ ID NO: 7366 - protein, 30 aa, synthetic construct
GSAPSASGEPPELGAGPGSPATSGSETPGT

SEQ ID NO: 7367 - protein, 30 aa, synthetic construct
GSAPSASGEPSGLTEGPGSPATSGSETPGT

SEQ ID NO: 7368 - protein, 30 aa, synthetic construct
GSAPSASGTPAPLTEPPGSPATSGSETPGT

SEQ ID NO: 7369 - protein, 30 aa, synthetic construct
GSAPSASGTPAELTEPPGSPATSGSETPGT

SEQ ID NO: 7370 - protein, 30 aa, synthetic construct
GSAPSASGPPPGLTGPPGSPATSGSETPGT

SEQ ID NO: 7371 - protein, 30 aa, synthetic construct
GSAPSASGTPAPLGGEPGSPATSGSETPGT

SEQ ID NO: 7372 - protein, 30 aa, synthetic construct
GSAPSPAGAPEGLTGPAGSPATSGSETPGT

SEQ ID NO: 7373 - protein, 30 aa, synthetic construct
GSAPSPAGPPEGLETEAGSPATSGSETPGT

SEQ ID NO: 7374 - protein, 30 aa, synthetic construct
GSAPSPTSGQGGLTGPGSEPATSGSETPGT

SEQ ID NO: 7375 - protein, 30 aa, synthetic construct
GSAPSESAPPEGLETESTEPATSGSETPGT

SEQ ID NO: 7376 - protein, 30 aa, synthetic construct
GSAPSEGSEPLELGAASETPATSGSETPGT

SEQ ID NO: 7377 - protein, 30 aa, synthetic construct
GSAPSEGSGPAGLEAPSETPATSGSETPGT

SEQ ID NO: 7378 - protein, 30 aa, synthetic construct
GSAPSEPTPPASLEAEPGSPATSGSETPGT

SEQ ID NO: 7379 - protein, 29 aa, synthetic construct
GTAEAASASGGSAGGYAELRMGGAIPGSP

SEQ ID NO: 7380 - protein, 29 aa, synthetic construct
GTAEAASASGGTGGGYAPLRMGGGAPGSP

SEQ ID NO: 7381 - protein, 29 aa, synthetic construct
GTAEAASASGGAEGGYAALRMGGEIPGSP

SEQ ID NO: 7382 - protein, 29 aa, synthetic construct
GTAEAASASGGGPGGYALLRMGGPAPGSP

SEQ ID NO: 7383 - protein, 29 aa, synthetic construct
GTAEAASASGGEAGGYAFLRMGGSIPGSP

SEQ ID NO: 7384 - protein, 29 aa, synthetic construct
GTAEAASASGGPGGGYASLRMGGTAPGSP

SEQ ID NO: 7385 - protein, 29 aa, synthetic construct
GTAEAASASGGSEGGYATLRMGGAIPGSP

SEQ ID NO: 7386 - protein, 29 aa, synthetic construct
GTAEAASASGGTPGGYANLRMGGGAPGSP

SEQ ID NO: 7387 - protein, 29 aa, synthetic construct
GTAEAASASGGASGGYAHLRMGGEIPGSP

SEQ ID NO: 7388 - protein, 29 aa, synthetic construct
GTAEAASASGGGTGGYGELRMGGPAPGSP

SEQ ID NO: 7389 - protein, 29 aa, synthetic construct
GTAEAASASGGEAGGYPELRMGGSIPGSP

SEQ ID NO: 7390 - protein, 29 aa, synthetic construct
GTAEAASASGGPGGGYVELRMGGTAPGSP

SEQ ID NO: 7391 - protein, 29 aa, synthetic construct
GTAEAASASGGSEGGYLELRMGGAIPGSP

SEQ ID NO: 7392 - protein, 29 aa, synthetic construct
GTAEAASASGGTPGGYSELRMGGGAPGSP

SEQ ID NO: 7393 - protein, 29 aa, synthetic construct
GTAEAASASGGASGGYTELRMGGEIPGSP

SEQ ID NO: 7394 - protein, 29 aa, synthetic construct
GTAEAASASGGGTGGYQELRMGGPAPGSP

SEQ ID NO: 7395 - protein, 29 aa, synthetic construct
GTAEAASASGGEAGGYEELRMGGSIPGSP

SEQ ID NO: 7396 - protein, 29 aa, synthetic construct
GTAEAASASGGPGIGPAELRMGGTAPGSP

SEQ ID NO: 7397 - protein, 29 aa, synthetic construct
GTAEAASASGGSEIGAAELRMGGAIPGSP

SEQ ID NO: 7398 - protein, 29 aa, synthetic construct
GTAEAASASGGTPIGSAELRMGGGAPGSP

SEQ ID NO: 7399 - protein, 29 aa, synthetic construct
GTAEAASASGGASIGTAELRMGGEIPGSP

SEQ ID NO: 7400 - protein, 29 aa, synthetic construct
GTAEAASASGGGTIGNAELRMGGPAPGSP

SEQ ID NO: 7401 - protein, 29 aa, synthetic construct
GTAEAASASGGEAIGQAELRMGGSIPGSP

SEQ ID NO: 7402 - protein, 29 aa, synthetic construct
GTAEAASASGGPGGPYAELRMGGTAPGSP

SEQ ID NO: 7403 - protein, 29 aa, synthetic construct
GTAEAASASGGSEGAYAELRMGGAIPGSP

SEQ ID NO: 7404 - protein, 29 aa, synthetic construct
GTAEAASASGGTPGVYAELRMGGGAPGSP

SEQ ID NO: 7405 - protein, 29 aa, synthetic construct
GTAEAASASGGASGLYAELRMGGEIPGSP

SEQ ID NO: 7406 - protein, 29 aa, synthetic construct
GTAEAASASGGGTGIYAELRMGGPAPGSP

SEQ ID NO: 7407 - protein, 29 aa, synthetic construct
GTAEAASASGGEAGFYAELRMGGSIPGSP

SEQ ID NO: 7408 - protein, 29 aa, synthetic construct
GTAEAASASGGPGGYYAELRMGGTAPGSP

SEQ ID NO: 7409 - protein, 29 aa, synthetic construct
GTAEAASASGGSEGSYAELRMGGAIPGSP

SEQ ID NO: 7410 - protein, 29 aa, synthetic construct
GTAEAASASGGTPGNYAELRMGGGAPGSP

SEQ ID NO: 7411 - protein, 29 aa, synthetic construct
GTAEAASASGGASGEYAELRMGGEIPGSP

SEQ ID NO: 7412 - protein, 29 aa, synthetic construct
GTAEAASASGGGTGHYAELRMGGPAPGSP

SEQ ID NO: 7413 - protein, 29 aa, synthetic construct
GTAEAASASGGEAGGYAEARMGGSIPGSP

SEQ ID NO: 7414 - protein, 29 aa, synthetic construct
GTAEAASASGGPGGGYAEVRMGGTAPGSP

SEQ ID NO: 7415 - protein, 29 aa, synthetic construct
GTAEAASASGGSEGGYAEIRMGGAIPGSP

SEQ ID NO: 7416 - protein, 29 aa, synthetic construct
GTAEAASASGGTPGGYAEFRMGGGAPGSP

SEQ ID NO: 7417 - protein, 29 aa, synthetic construct
GTAEAASASGGASGGYAEYRMGGEIPGSP

SEQ ID NO: 7418 - protein, 29 aa, synthetic construct
GTAEAASASGGGTGGYAESRMGGPAPGSP

SEQ ID NO: 7419 - protein, 29 aa, synthetic construct
GTAEAASASGGEAGGYAETRMGGSIPGSP

SEQ ID NO: 7420 - protein, 29 aa, synthetic construct
GTAEAASASGGPGGGYAELAMGGTRPGSP

SEQ ID NO: 7421 - protein, 29 aa, synthetic construct
GTAEAASASGGSEGGYAELVMGGARPGSP

SEQ ID NO: 7422 - protein, 29 aa, synthetic construct
GTAEAASASGGTPGGYAELLMGGGRPGSP

SEQ ID NO: 7423 - protein, 29 aa, synthetic construct
GTAEAASASGGASGGYAELIMGGERPGSP

SEQ ID NO: 7424 - protein, 29 aa, synthetic construct
GTAEAASASGGGTGGYAELWMGGPRPGSP

SEQ ID NO: 7425 - protein, 29 aa, synthetic construct
GTAEAASASGGEAGGYAELSMGGSRPGSP

SEQ ID NO: 7426 - protein, 29 aa, synthetic construct
GTAEAASASGGPGGGYAELTMGGTRPGSP

SEQ ID NO: 7427 - protein, 29 aa, synthetic construct
GTAEAASASGGSEGGYAELQMGGARPGSP

SEQ ID NO: 7428 - protein, 29 aa, synthetic construct
GTAEAASASGGTPGGYAELNMGGGRPGSP

SEQ ID NO: 7429 - protein, 29 aa, synthetic construct
GTAEAASASGGASGGYAELEMGGERPGSP

SEQ ID NO: 7430 - protein, 29 aa, synthetic construct
GTAEAASASGGGTGGYAELRPGGPIPGSP

SEQ ID NO: 7431 - protein, 29 aa, synthetic construct
GTAEAASASGGEAGGYAELRAGGSAPGSP

SEQ ID NO: 7432 - protein, 29 aa, synthetic construct
GTAEAASASGGPGGGYAELRLGGTIPGSP

SEQ ID NO: 7433 - protein, 29 aa, synthetic construct
GTAEAASASGGSEGGYAELRIGGAAPGSP

SEQ ID NO: 7434 - protein, 29 aa, synthetic construct
GTAEAASASGGTPGGYAELRSGGGIPGSP

SEQ ID NO: 7435 - protein, 29 aa, synthetic construct
GTAEAASASGGASGGYAELRNGGEAPGSP

SEQ ID NO: 7436 - protein, 29 aa, synthetic construct
GTAEAASASGGGTGGYAELRQGGPIPGSP

SEQ ID NO: 7437 - protein, 29 aa, synthetic construct
GTAEAASASGGEAGGYAELRDGGSAPGSP

SEQ ID NO: 7438 - protein, 29 aa, synthetic construct
GTAEAASASGGPGGGYAELREGGTIPGSP

SEQ ID NO: 7439 - protein, 29 aa, synthetic construct
GTAEAASASGGSEGGYAELRHGGAAPGSP

SEQ ID NO: 7440 - protein, 29 aa, synthetic construct
GTAEAASASGGTPGGYAELRMPGGIPGSP

SEQ ID NO: 7441 - protein, 29 aa, synthetic construct
GTAEAASASGGASGGYAELRMAGEAPGSP

SEQ ID NO: 7442 - protein, 29 aa, synthetic construct
GTAEAASASGGGTGGYAELRMVGPIPGSP

SEQ ID NO: 7443 - protein, 29 aa, synthetic construct
GTAEAASASGGEAGGYAELRMLGSAPGSP

SEQ ID NO: 7444 - protein, 29 aa, synthetic construct
GTAEAASASGGPGGGYAELRMIGTIPGSP

SEQ ID NO: 7445 - protein, 29 aa, synthetic construct
GTAEAASASGGSEGGYAELRMYGAIPGSP

SEQ ID NO: 7446 - protein, 29 aa, synthetic construct
GTAEAASASGGTPGGYAELRMSGGAPGSP

SEQ ID NO: 7447 - protein, 29 aa, synthetic construct
GTAEAASASGGASGGYAELRMNGEIPGSP

SEQ ID NO: 7448 - protein, 29 aa, synthetic construct
GTAEAASASGGGTGGYAELRMQGPAPGSP

SEQ ID NO: 7449 - protein, 29 aa, synthetic construct
GTAEAASASGGANHTPAGLTGPGARPGSP

SEQ ID NO: 7450 - protein, 29 aa, synthetic construct
GTAEAASASGGANTAPEGLTGPSTRPGSP

SEQ ID NO: 7451 - protein, 29 aa, synthetic construct
GTAEAASASGGTGAPPGGLTGPGTRPGSP

SEQ ID NO: 7452 - protein, 29 aa, synthetic construct
GTAEAASASGGANHEPSGLTEGSPRPGSP

SEQ ID NO: 7453 - protein, 29 aa, synthetic construct
GTAEAASASGGANTEPPELGAGTERPGSP

SEQ ID NO: 7454 - protein, 29 aa, synthetic construct
GTAEAASASGGASGPPPGLTGPPGRPGSP

SEQ ID NO: 7455 - protein, 29 aa, synthetic construct
GTAEAASASGGASGTPAPLGGEPGRPGSP

SEQ ID NO: 7456 - protein, 29 aa, synthetic construct
GTAEAASASGGPAGPPEGLETEAGRPGSP

SEQ ID NO: 7457 - protein, 29 aa, synthetic construct
GTAEAASASGGPTSGQGGLTGPESRPGSP

SEQ ID NO: 7458 - protein, 29 aa, synthetic construct
GTAEAASASGGSAGGAANLVRGGAIPGSP

SEQ ID NO: 7459 - protein, 29 aa, synthetic construct
GTAEAASASGGTGGGAAPLVRGGGAPGSP

SEQ ID NO: 7460 - protein, 29 aa, synthetic construct
GTAEAASASGGAEGGAAALVRGGEIPGSP

SEQ ID NO: 7461 - protein, 29 aa, synthetic construct
GTAEAASASGGGPGGAALLVRGGPAPGSP

SEQ ID NO: 7462 - protein, 29 aa, synthetic construct
GTAEAASASGGEAGGAAFLVRGGSIPGSP

SEQ ID NO: 7463 - protein, 29 aa, synthetic construct
GTAEAASASGGPGGGAASLVRGGTAPGSP

SEQ ID NO: 7464 - protein, 29 aa, synthetic construct
GTAEAASASGGSEGGAATLVRGGAIPGSP

SEQ ID NO: 7465 - protein, 29 aa, synthetic construct
GTAEAASASGGTPGGAAGLVRGGGAPGSP

SEQ ID NO: 7466 - protein, 29 aa, synthetic construct
GTAEAASASGGASGGAADLVRGGEIPGSP

SEQ ID NO: 7467 - protein, 29 aa, synthetic construct
GTAEAASASGGGTGGAGNLVRGGPAPGSP

SEQ ID NO: 7468 - protein, 29 aa, synthetic construct
GTAEAASASGGEAGGAPNLVRGGSIPGSP

SEQ ID NO: 7469 - protein, 29 aa, synthetic construct
GTAEAASASGGPGGGAVNLVRGGTAPGSP

SEQ ID NO: 7470 - protein, 29 aa, synthetic construct
GTAEAASASGGSEGGALNLVRGGAIPGSP

SEQ ID NO: 7471 - protein, 29 aa, synthetic construct
GTAEAASASGGTPGGASNLVRGGGAPGSP

SEQ ID NO: 7472 - protein, 29 aa, synthetic construct
GTAEAASASGGASGGATNLVRGGEIPGSP

SEQ ID NO: 7473 - protein, 29 aa, synthetic construct
GTAEAASASGGGTGGAQNLVRGGPAPGSP

SEQ ID NO: 7474 - protein, 29 aa, synthetic construct
GTAEAASASGGEAGGAENLVRGGSIPGSP

SEQ ID NO: 7475 - protein, 30 aa, synthetic construct
GTAEAASASGEAGRSANHEPLGLVATPGSP

SEQ ID NO: 7476 - protein, 30 aa, synthetic construct
GTAEAASASGASGRSTNAGPSGLAGPPGSP

SEQ ID NO: 7477 - protein, 30 aa, synthetic construct
GTAEAASASGASGRSTNAGPQGLAGQPGSP

SEQ ID NO: 7478 - protein, 30 aa, synthetic construct
GTAEAASASGASGRSTNAGPPGLTGPPGSP

SEQ ID NO: 7479 - protein, 30 aa, synthetic construct
GTAEAASASGASSRGTNAGPAGLTGPPGSP

SEQ ID NO: 7480 - protein, 30 aa, synthetic construct
GTAEAASASGASSRTTNTGPSTLTGPPGSP

SEQ ID NO: 7481 - protein, 30 aa, synthetic construct
GTAEAASASGAAGRSDNGTPLELVAPPGSP

SEQ ID NO: 7482 - protein, 30 aa, synthetic construct; identical to SEQ ID NO: 7475

SEQ ID NO: 7483 - protein, 30 aa, synthetic construct
GTAEAASASGASGRGTNAGPAGLTGPPGSP

SEQ ID NO: 7484 - protein, 30 aa, synthetic construct
GTAEAASASGLFGRNDNHEPLELGGGPGSP

SEQ ID NO: 7485 - protein, 30 aa, synthetic construct
GTAEAASASGTAGRSDNLEPLGLVFGPGSP

SEQ ID NO: 7486 - protein, 30 aa, synthetic construct
GTAEAASASGLDGRSDNFHPPELVAGPGSP

SEQ ID NO: 7487 - protein, 30 aa, synthetic construct
GTAEAASASGLEGRSDNEEPENLVAGPGSP

SEQ ID NO: 7488 - protein, 30 aa, synthetic construct
GTAEAASASGLKGRSDNNAPLALVAGPGSP

SEQ ID NO: 7489 - protein, 30 aa, synthetic construct
GTAEAASASGVYSRGTNAGPHGLTGRPGSP

SEQ ID NO: 7490 - protein, 30 aa, synthetic construct
GTAEAASASGANSRGTNKGFAGLIGPPGSP

SEQ ID NO: 7491 - protein, 30 aa, synthetic construct
GTAEAASASGASSRLTNEAPAGLTIPPGSP

SEQ ID NO: 7492 - protein, 30 aa, synthetic construct
GTAEAASASGDQSRGTNAGPEGLTDPPGSP

SEQ ID NO: 7493 - protein, 30 aa, synthetic construct
GTAEAASASGESSRGTNIGQGGLTGPPGSP

SEQ ID NO: 7494 - protein, 30 aa, synthetic construct
GTAEAASASGSSSRGTNQDPAGLTIPPGSP

SEQ ID NO: 7495 - protein, 30 aa, synthetic construct
GTAEAASASGASSRGQNHSPMGLTGPPGSP

SEQ ID NO: 7496 - protein, 30 aa, synthetic construct
GTAEAASASGAYSRGPNAGPAGLEGRPGSP

SEQ ID NO: 7497 - protein, 30 aa, synthetic construct
GTAEAASASGASERGNNAGPANLTGFPGSP

SEQ ID NO: 7498 - protein, 30 aa, synthetic construct
GTAEAASASGASHRGTNPKPAILTGPPGSP

SEQ ID NO: 7499 - protein, 30 aa, synthetic construct
GTAEAASASGMSSRRTNANPAQLTGPPGSP

SEQ ID NO: 7500 - protein, 30 aa, synthetic construct
GTAEAASASGGAGRTDNHEPLELGAAPGSP

SEQ ID NO: 7501 - protein, 30 aa, synthetic construct
GTAEAASASGLAGRSENTAPLELTAGPGSP

SEQ ID NO: 7502 - protein, 30 aa, synthetic construct
GTAEAASASGLEGRPDNHEPLALVASPGSP

SEQ ID NO: 7503 - protein, 30 aa, synthetic construct
GTAEAASASGLSGRSDNEEPLALPAGPGSP

SEQ ID NO: 7504 - protein, 30 aa, synthetic construct
GTAEAASASGEAGRTDNHEPLELSAPPGSP

SEQ ID NO: 7505 - protein, 30 aa, synthetic construct
GTAEAASASGEGGRSDNHGPLELVSGPGSP

SEQ ID NO: 7506 - protein, 30 aa, synthetic construct
GTAEAASASGLSGRSDNEAPLELEAGPGSP

SEQ ID NO: 7507 - protein, 30 aa, synthetic construct
GTAEAASASGLGGRADNHEPPELGAGPGSP

SEQ ID NO: 7508 - protein, 30 aa, synthetic construct
GTAEAASASGPPSRGTNAEPAGLTGEPGSP

SEQ ID NO: 7509 - protein, 30 aa, synthetic construct
GTAEAASASGASTRGENAGPAGLEAPPGSP

SEQ ID NO: 7510 - protein, 30 aa, synthetic construct
GTAEAASASGESSRGTNGAPEGLTGPPGSP

SEQ ID NO: 7511 - protein, 30 aa, synthetic construct
GTAEAASASGASSRATNESPAGLTGEPGSP

SEQ ID NO: 7512 - protein, 30 aa, synthetic construct
GTAEAASASGASSRGENPPPGGLTGPPGSP

SEQ ID NO: 7513 - protein, 30 aa, synthetic construct
GTAEAASASGAASRGTNTGPAELTGSPGSP

SEQ ID NO: 7514 - protein, 30 aa, synthetic construct
GTAEAASASGAGSRTTNAGPGGLEGPPGSP

SEQ ID NO: 7515 - protein, 30 aa, synthetic construct
GTAEAASASGAPSRGENAGPATLTGAPGSP

SEQ ID NO: 7516 - protein, 30 aa, synthetic construct
GTAEAASASGESGRAANTGPPTLTAPPGSP

SEQ ID NO: 7517 - protein, 30 aa, synthetic construct
GTAEAASASGNPGRAANEGPPGLPGSPGSP

SEQ ID NO: 7518 - protein, 30 aa, synthetic construct
GTAEAASASGESSRAANLTPPELTGPPGSP

SEQ ID NO: 7519 - protein, 30 aa, synthetic construct
GTAEAASASGASGRAANETPPGLTGAPGSP

SEQ ID NO: 7520 - protein, 30 aa, synthetic construct
GTAEAASASGNSGRGENLGAPGLTGTPGSP

SEQ ID NO: 7521 - protein, 30 aa, synthetic construct
GTAEAASASGTTGRAANLTPAGLTGPPGSP

SEQ ID NO: 7522 - protein, 30 aa, synthetic construct
GTAEAASASGEAGRSANHTPAGLTGPPGSP

SEQ ID NO: 7523 - protein, 30 aa, synthetic construct
GTAEAASASGESGRAANTTPAGLTGPPGSP

SEQ ID NO: 7524 - protein, 33 aa, synthetic construct
GTAEAASASGTTGRATEAANLTPAGLTGPPGSP

SEQ ID NO: 7525 - protein, 33 aa, synthetic construct
GTAEAASASGTTGRAEEAANLTPAGLTGPPGSP

SEQ ID NO: 7526 - protein, 33 aa, synthetic construct
GTAEAASASGTTGRAGEAANLTPAGLTGPPGSP

SEQ ID NO: 7527 - protein, 33 aa, synthetic construct
GTAEAASASGTTGRATEAANATPAGLTGPPGSP

SEQ ID NO: 7528 - protein, 33 aa, synthetic construct
GTAEAASASGTTGRAGEAEGATSAGATGPPGSP

SEQ ID NO: 7529 - protein, 33 aa, synthetic construct
GTAEAASASGTTGEAGEAANATSAGATGPPGSP

SEQ ID NO: 7530 - protein, 33 aa, synthetic construct
GTAEAASASGTTGEAGEAAGLTPAGLTGPPGSP

SEQ ID NO: 7531 - protein, 33 aa, synthetic construct
GTAEAASASGTTGAAGEAANATPAGLTGPPGSP

SEQ ID NO: 7532 - protein, 33 aa, synthetic construct
GTAEAASASGTTGRAGEAAGLTPAGLTGPPGSP

SEQ ID NO: 7533 - protein, 33 aa, synthetic construct
GTAEAASASGTTGRAGEAANATSAGATGPPGSP

SEQ ID NO: 7534 - protein, 33 aa, synthetic construct
GTAEAASASGTTGEAGEAAGATSAGATGPPGSP

SEQ ID NO: 7535 - protein, 30 aa, synthetic construct
GTAEAASASGESGRAANTEPPELGAGPGSP

SEQ ID NO: 7536 - protein, 30 aa, synthetic construct
GTAEAASASGESGRAANTAPEGLTGPPGSP

SEQ ID NO: 7537 - protein, 30 aa, synthetic construct
GTAEAASASGEPGRAANHEPSGLTEGPGSP

SEQ ID NO: 7538 - protein, 33 aa, synthetic construct
GTAEAASASGESGRAANHTGAPPGGLTGPPGSP

SEQ ID NO: 7539 - protein, 33 aa, synthetic construct
GTAEAASASGTTGRTGEGANATPGGLTGPPGSP

SEQ ID NO: 7540 - protein, 33 aa, synthetic construct
GTAEAASASGRTGRSGEAANETPEGLEGPPGSP

SEQ ID NO: 7541 - protein, 33 aa, synthetic construct
GTAEAASASGRTGRTGESANETPAGLGGPPGSP

SEQ ID NO: 7542 - protein, 33 aa, synthetic construct
GTAEAASASGSTGRTGEPANETPAGLSGPPGSP

SEQ ID NO: 7543 - protein, 33 aa, synthetic construct
GTAEAASASGTTGRAGEPANATPTGLSGPPGSP

SEQ ID NO: 7544 - protein, 33 aa, synthetic construct
GTAEAASASGRTGRPGEGANATPTGLPGPPGSP

SEQ ID NO: 7545 - protein, 33 aa, synthetic construct
GTAEAASASGRTGRGGEAANATPSGLGGPPGSP

SEQ ID NO: 7546 - protein, 33 aa, synthetic construct
GTAEAASASGSTGRSGESANATPGGLGGPPGSP

SEQ ID NO: 7547 - protein, 33 aa, synthetic construct
GTAEAASASGRTGRTGEEANATPAGLPGPPGSP

SEQ ID NO: 7548 - protein, 33 aa, synthetic construct
GTAEAASASGATGRPGEPANTTPEGLEGPPGSP

SEQ ID NO: 7549 - protein, 33 aa, synthetic construct
GTAEAASASGSTGRSGEPANATPGGLTGPPGSP

SEQ ID NO: 7550 - protein, 33 aa, synthetic construct
GTAEAASASGPTGRGGEGANTTPTGLPGPPGSP

SEQ ID NO: 7551 - protein, 33 aa, synthetic construct
GTAEAASASGPTGRSGEGANATPSGLTGPPGSP

SEQ ID NO: 7552 - protein, 33 aa, synthetic construct
GTAEAASASGTTGRASEGANSTPAPLTEPPGSP

SEQ ID NO: 7553 - protein, 33 aa, synthetic construct
GTAEAASASGTYGRAAEAANTTPAGLTAPPGSP

SEQ ID NO: 7554 - protein, 33 aa, synthetic construct
GTAEAASASGTTGRATEGANATPAELTEPPGSP

SEQ ID NO: 7555 - protein, 33 aa, synthetic construct
GTAEAASASGTVGRASEEANTTPASLTGPPGSP

SEQ ID NO: 7556 - protein, 33 aa, synthetic construct
GTAEAASASGTTGRAPEAANATPAPLTGPPGSP

SEQ ID NO: 7557 - protein, 33 aa, synthetic construct
GTAEAASASGTWGRATEPANATPAPLTSPPGSP

SEQ ID NO: 7558 - protein, 33 aa, synthetic construct
GTAEAASASGTVGRASESANATPAELTSPPGSP

SEQ ID NO: 7559 - protein, 33 aa, synthetic construct
GTAEAASASGTVGRAPEGANSTPAGLTGPPGSP

SEQ ID NO: 7560 - protein, 33 aa, synthetic construct
GTAEAASASGTWGRATEAPNLEPATLTTPPGSP

SEQ ID NO: 7561 - protein, 33 aa, synthetic construct
GTAEAASASGTTGRATEAPNLTPAPLTEPPGSP

SEQ ID NO: 7562 - protein, 33 aa, synthetic construct
GTAEAASASGTQGRATEAPNLSPAALTSPPGSP

SEQ ID NO: 7563 - protein, 33 aa, synthetic construct
GTAEAASASGTQGRAAEAPNLTPATLTAPPGSP

SEQ ID NO: 7564 - protein, 33 aa, synthetic construct
GTAEAASASGTSGRAPEATNLAPAPLTGPPGSP

SEQ ID NO: 7565 - protein, 33 aa, synthetic construct
GTAEAASASGTQGRAAEAANLTPAGLTEPPGSP

SEQ ID NO: 7566 - protein, 33 aa, synthetic construct
GTAEAASASGTTGRAGSAPNLPPTGLTTPPGSP

SEQ ID NO: 7567 - protein, 33 aa, synthetic construct
GTAEAASASGTTGRAGGAENLPPEGLTAPPGSP

SEQ ID NO: 7568 - protein, 33 aa, synthetic construct
GTAEAASASGTTSRAGTATNLTPEGLTAPPGSP

SEQ ID NO: 7569 - protein, 33 aa, synthetic construct
GTAEAASASGTTGRAGTATNLPPSGLTTPPGSP

SEQ ID NO: 7570 - protein, 33 aa, synthetic construct
GTAEAASASGTTARAGEAENLSPSGLTAPPGSP

SEQ ID NO: 7571 - protein, 33 aa, synthetic construct
GTAEAASASGTTGRAGGAGNLAPGGLTEPPGSP

SEQ ID NO: 7572 - protein, 33 aa, synthetic construct
GTAEAASASGTTGRAGTATNLPPEGLTGPPGSP

SEQ ID NO: 7573 - protein, 33 aa, synthetic construct
GTAEAASASGTTGRAGGAANLAPTGLTEPPGSP

SEQ ID NO: 7574 - protein, 33 aa, synthetic construct
GTAEAASASGTTGRAGTAENLAPSGLTTPPGSP

SEQ ID NO: 7575 - protein, 33 aa, synthetic construct
GTAEAASASGTTGRAGSATNLGPGGLTGPPGSP

SEQ ID NO: 7576 - protein, 33 aa, synthetic construct
GTAEAASASGTTARAGGAENLTPAGLTEPPGSP

SEQ ID NO: 7577 - protein, 33 aa, synthetic construct
GTAEAASASGTTARAGSAENLSPSGLTGPPGSP

SEQ ID NO: 7578 - protein, 33 aa, synthetic construct
GTAEAASASGTTARAGGAGNLAPEGLTTPPGSP

SEQ ID NO: 7579 - protein, 33 aa, synthetic construct
GTAEAASASGTTSRAGAAENLTPTGLTGPPGSP

SEQ ID NO: 7580 - protein, 33 aa, synthetic construct
GTAEAASASGTYGRTTTPGNEPPASLEAEPGSP

SEQ ID NO: 7581 - protein, 33 aa, synthetic construct
GTAEAASASGTYSRGESGPNEPPPGLTGPPGSP

SEQ ID NO: 7582 - protein, 33 aa, synthetic construct
GTAEAASASGAWGRTGASENETPAPLGGEPGSP

SEQ ID NO: 7583 - protein, 33 aa, synthetic construct
GTAEAASASGRWGRAETTPNTPPEGLETEPGSP

SEQ ID NO: 7584 - protein, 33 aa, synthetic construct
GTAEAASASGESGRAANHTGAEPPELGAGPGSP

SEQ ID NO: 7585 - protein, 33 aa, synthetic construct
GTAEAASASGTTGRAGEAANLTPAGLTESPGSP

SEQ ID NO: 7586 - protein, 33 aa, synthetic construct
GTAEAASASGTTGRAGEAANLTPAALTESPGSP

SEQ ID NO: 7587 - protein, 33 aa, synthetic construct
GTAEAASASGTTGRAGEAANLTPAPLTESPGSP

SEQ ID NO: 7588 - protein, 33 aa, synthetic construct
GTAEAASASGTTGRAGEAANLTPEPLTESPGSP

SEQ ID NO: 7589 - protein, 33 aa, synthetic construct
GTAEAASASGTTGRAGEAANLTPAGLTGAPGSP

SEQ ID NO: 7590 - protein, 33 aa, synthetic construct
GTAEAASASGTTGRAGEAANLTPEGLTGAPGSP

SEQ ID NO: 7591 - protein, 33 aa, synthetic construct
GTAEAASASGTTGRAGEAANLTPEPLTGAPGSP

SEQ ID NO: 7592 - protein, 33 aa, synthetic construct
GTAEAASASGTTGRAGEAANLTPAGLTEAPGSP

SEQ ID NO: 7593 - protein, 33 aa, synthetic construct
GTAEAASASGTTGRAGEAANLTPEGLTEAPGSP

SEQ ID NO: 7594 - protein, 33 aa, synthetic construct
GTAEAASASGTTGRAGEAANLTPAPLTEAPGSP

SEQ ID NO: 7595 - protein, 33 aa, synthetic construct
GTAEAASASGTTGRAGEAANLTPEPLTEAPGSP

SEQ ID NO: 7596 - protein, 33 aa, synthetic construct
GTAEAASASGTTGRAGEAANLTPEPLTGPPGSP

SEQ ID NO: 7597 - protein, 33 aa, synthetic construct
GTAEAASASGTTGRAGEAANLTPAGLTGGPGSP

SEQ ID NO: 7598 - protein, 33 aa, synthetic construct
GTAEAASASGTTGRAGEAANLTPEGLTGGPGSP

SEQ ID NO: 7599 - protein, 33 aa, synthetic construct
GTAEAASASGTTGRAGEAANLTPEALTGGPGSP

SEQ ID NO: 7600 - protein, 33 aa, synthetic construct
GTAEAASASGTTGRAGEAANLTPEPLTGGPGSP

SEQ ID NO: 7601 - protein, 33 aa, synthetic construct
GTAEAASASGTTGRAGEAANLTPAGLTEGPGSP

SEQ ID NO: 7602 - protein, 33 aa, synthetic construct
GTAEAASASGTTGRAGEAANLTPEGLTEGPGSP

SEQ ID NO: 7603 - protein, 33 aa, synthetic construct
GTAEAASASGTTGRAGEAANLTPAPLTEGPGSP

SEQ ID NO: 7604 - protein, 33 aa, synthetic construct
GTAEAASASGTTGRAGEAANLTPEPLTEGPGSP

SEQ ID NO: 7605 - protein, 33 aa, synthetic construct; identical to SEQ ID NO: 7528

SEQ ID NO: 7606 - protein, 30 aa, synthetic construct
GTAEAASASGEAGRSAEATSAGATGPPGSP

SEQ ID NO: 7607 - protein, 30 aa, synthetic construct
GTAEAASASGSASGTYSRGESGPGSPPGSP

SEQ ID NO: 7608 - protein, 30 aa, synthetic construct
GTAEAASASGSASGEAGRTDTHPGSPPGSP

SEQ ID NO: 7609 - protein, 30 aa, synthetic construct
GTAEAASASGSASGEPGRAAEHPGSPPGSP

SEQ ID NO: 7610 - protein, 30 aa, synthetic construct
GTAEAASASGSPAGESSRGTTIAGSPPGSP

SEQ ID NO: 7611 - protein, 33 aa, synthetic construct; identical to SEQ ID NO: 7530

SEQ ID NO: 7612 - protein, 30 aa, synthetic construct
GTAEAASASGEAGESAGATPAGLTGPPGSP

SEQ ID NO: 7613 - protein, 30 aa, synthetic construct
GTAEAASASGSASGAPLELEAGPGSPPGSP

SEQ ID NO: 7614 - protein, 30 aa, synthetic construct
GTAEAASASGSASGEPPELGAGPGSPPGSP

SEQ ID NO: 7615 - protein, 30 aa, synthetic construct
GTAEAASASGSASGEPSGLTEGPGSPPGSP

SEQ ID NO: 7616 - protein, 30 aa, synthetic construct
GTAEAASASGSASGTPAPLTEPPGSPPGSP

SEQ ID NO: 7617 - protein, 30 aa, synthetic construct
GTAEAASASGSASGTPAELTEPPGSPPGSP

SEQ ID NO: 7618 - protein, 30 aa, synthetic construct
GTAEAASASGSASGPPPGLTGPPGSPPGSP

SEQ ID NO: 7619 - protein, 30 aa, synthetic construct
GTAEAASASGSASGTPAPLGGEPGSPPGSP

SEQ ID NO: 7620 - protein, 30 aa, synthetic construct
GTAEAASASGSPAGAPEGLTGPAGSPPGSP

SEQ ID NO: 7621 - protein, 30 aa, synthetic construct
GTAEAASASGSPAGPPEGLETEAGSPPGSP

SEQ ID NO: 7622 - protein, 30 aa, synthetic construct
GTAEAASASGSPTSGQGGLTGPGSEPPGSP

SEQ ID NO: 7623 - protein, 30 aa, synthetic construct
GTAEAASASGSESAPPEGLETESTEPPGSP

SEQ ID NO: 7624 - protein, 30 aa, synthetic construct
GTAEAASASGSEGSEPLELGAASETPPGSP

SEQ ID NO: 7625 - protein, 30 aa, synthetic construct
GTAEAASASGSEGSGPAGLEAPSETPPGSP

SEQ ID NO: 7626 - protein, 30 aa, synthetic construct
GTAEAASASGSEPTPPASLEAEPGSPPGSP

SEQ ID NO: 7627 - protein, 16 aa, synthetic construct
  VARIANT 7: note = X can be any amino acid other than N
EAGRSAXHTPAGLTGP

SEQ ID NO: 7628 - protein, 16 aa, synthetic construct
EAGRSASHTPAGLTGP

SEQ ID NO: 7629-8000 - skipped (372 entries)

SEQ ID NO: 8001 - protein, 874 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGFTABTSESATPESGPGSEPATSGPTESGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8002 - protein, 870 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGPTESGSEPATSGSETPGSPAGSPTSTEEGTSTEPSEGSAPGTSTEPSEGSAPGSEPATSGSETPGTSESATPESGPGTSTEPSEGSAPGEPEA

SEQ ID NO: 8003 - protein, 870 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8004 - protein, 294 aa, synthetic construct
ASSPAGSPTSTESGTSESATPESGPGTETEPSEGSAPGTSESATPESGPGSEPATSGSETPGTSESATPESGPGSTPAESGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8005 - protein, 294 aa, synthetic construct
ASSPAGSPTSTESGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGESPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8006 - protein, 294 aa, synthetic construct
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGEEPATSGSTPEGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8007 - protein, 294 aa, synthetic construct
ASSPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8008 - protein, 866 aa, synthetic construct
PGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 8009 - protein, 578 aa, synthetic construct
PGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPG

SEQ ID NO: 8010 - protein, 1152 aa, synthetic construct
SAGSPGSPAGSPTSTEEGTSESATPESGPGTSTEPSEGSAPGSPAGSPTSTEEGTSTEPSEGSAPGTSTEPSEGSAPGTSESATPESGPGSTPAESGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSTETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTESAS

SEQ ID NO: 8011 - protein, 1153 aa, synthetic construct
SAGSPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAPGSPAGSPTSTEEGTSESATPESGPGTSTEPSEGSAPGSPAGSPTSTEEGTSTEPSEGSAPGTSTEPSEGSAPGTSESATPESGPGSEPATSGSETPGSEPATSGSTETPGSPAGSPTSTEEGTSESATPESGPGTSTEPSEGSAPGTSTEPSEGSAPGSPAGSPTSTEEGTSTEPSEGSAPGTATESPEGSAPGTSESATPESGPGTSTEPSEGSAPGTSAESATPESGPGSEPATSGSETPGTSTEPSEGSAPGTSTEPSEGSAPGTSESATPESGPGTESAS

SEQ ID NO: 8012 - protein, 864 aa, synthetic construct
GSPAGSPTSTEEGTSESATPESGPGTSTEPSEGSAPGSPAGSPTSTEEGTSTEPSEGSAPGTSTEPSEGSAPATSESATPESGPGSEPATSGSETPGSEPATSGSETPGSPAGSPTSTEEGTSESASPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 8013 - protein, 864 aa, synthetic construct
GSPAGSPTSTEEGTSESATPESGPGTSTEPSEGSAPGSPAGSPTSTEEGTSTEPSEGSAPGTSTEPSEGSAPGTSESATPESGPGSESATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATPESGPGTSTEPSEGSAP

SEQ ID NO: 8014 - protein, 292 aa, synthetic construct
SPAGSPTSTESGTSESATPESGPGTSTEPSEGSAPGTSESATPESGPGSEPATSGSETPGTSESATPESGPGSTPAESGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGGSAP

SEQ ID NO: 8015 - protein, 582 aa, synthetic construct
PGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTESTPSEGSAPGSEPATSGSETPGTSESATPESGPGTSTEPSEGSAPGEPEA

SEQ ID NO: 8016 - protein, 576 aa, synthetic construct
TPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSESATSGSETPGSPAGSPTSTEEGTSTEPSEGSAPGTSTEPSEGSAPGSEPATSGSETPGTSESA

SEQ ID NO: 8017 - protein, 576 aa, synthetic construct
GTSTEPSEGSAPGTSESATPESGPGSEPATSGSETPGSEPATSGSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESASPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGP

SEQ ID NO: 8018 - protein, 576 aa, synthetic construct
GSETPGSPAGSPTSTEEGTSESATPESGPGTSTEPSEGSAPGTSTEPSEGSAPGSPAGSPTSTEEGTSTEPSEGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSTETGTSESATPESGPGSEPATSGSETPGTSESATPESGPGTSTEPSEGSAPGSPAGSPTSTEEGTSESATPESGPGSEPATS

SEQ ID NO: 8019 - protein, 576 aa, synthetic construct
EGSAPGTSTEPSEGSAPGTSESATPESGPGTSTEPSEGSAPGTSESATPESGPGSEPATSGSETPGTSTEPSEGSAPGTSTEPSEGSAPGTSESATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESASPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESAT

SEQ ID NO: 8020 - protein, 294 aa, synthetic construct; identical to SEQ ID NO: 8007

SEQ ID NO: 8021 - protein, 294 aa, synthetic construct
ASSATPESGPGTSTEPSEGSAPGTSESATPESGPGSGPGTSESATPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSESATPESGPGSEPATSGSETPGSEPATSGSETPGSPAGSPTSTEEGTSTEPSEGSAPGTSTEPSEGSAPGSEPATSGSETPGTSESATP

SEQ ID NO: 8022 - protein, 582 aa, synthetic construct
ATPESGPGTSESATPESGPGSPAGSPTSTEEGTSESATPESGPGSEPATSGSETPGTSESATPESGPGTSTEPSEGSAPGTSTEPSEGSAPGTSTEPSEGSAPGTSTEPSEGSAPGTSTEPSEGSAPGTSTEPSEGSAPGSPAGSPTSTEEGTSTEPSEGSAPGTSESATPESGPGSEPATSGSETPGTSESATPESGPGSEPATSGSETPGTSESATPESGPGTSTEPSEGSAPGTSESATPESGPGSPAGSPTSTEEGSPAGSPTSTEEGSPAGSPTSTEEGTSESATPESGPGTSTEPSEGSAPGTSESATPESGPGSEPATSGSETPGTSESATPESGPGSEPATSGSETPGTSESATPESGPGTSTEPSEGSAPGSPAGSPTSTEEGTSESATPESGPGSEPATSGSETPGTSESATPESGPGSPAGSPTSTEEGSPAGSPTSTEEGTSTEPSEGSAPGTSESATPESGPGTSESATPESGPGTSPSATPESGPGSEPATSGSETPGSEPATSGSETPGSPAGSPTSTEEGTSTEPSEGSAPGTSTEPSEGSAPGSEPATSGSETPGTSESAGEPEA

SEQ ID NO: 8023 - protein, 14 aa, synthetic construct
  VARIANT 4: note = X can be T or N
  VARIANT 9: note = X can be T or S
RSSXGAVTXSNYAN

SEQ ID NO: 8024 - protein, 9 aa, synthetic construct
  VARIANT 5: note = X can be S or P
ALWYXNLWV

SEQ ID NO: 8025 - protein, 10 aa, synthetic construct
  VARIANT 5: note = X can be S or N
GFTFXTYAMN

SEQ ID NO: 8026 - protein, 19 aa, synthetic construct
  VARIANT 4: note = X can be T or S
  VARIANT 6: note = X can be R or Y
  VARIANT 19: note = X can be G or D
RIRXKXNBYATYYADSVKX

SEQ ID NO: 8027 - protein, 14 aa, synthetic construct
  VARIANT 2: note = X can be E or G
  VARIANT 14: note = X can be H or Y
HXNFGNSYVSWFAX

SEQ ID NO: 8028 - protein, 12 aa, synthetic construct
GSGPGTSESATP

SEQ ID NO: 8029 - protein, 12 aa, synthetic construct
GTSPSATPESGP

SEQ ID NO: 8030 - protein, 8 aa, synthetic construct
ATPESGPG

SEQ ID NO: 8031 - protein, 8 aa, synthetic construct
SGSETPGT

SEQ ID NO: 8032 - protein, 8 aa, synthetic construct
GTSESATP

SEQ ID NO: 8033 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXSGPESGPG

SEQ ID NO: 8034 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXATPESGPG

SEQ ID NO: 8035 - protein, 46 aa, synthetic construct
  VARIANT 9..38: note = Up to 30 X residues may be deleted
  VARIANT 9..38: note = X can be any amino acid
SGPESGPGXXXXXXXXXXXXXXXXXXXXXXXXXXXXXXATPESGPG

SEQ ID NO: 8036 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXGTSESATP

SEQ ID NO: 8037 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXTTPESGPG

SEQ ID NO: 8038 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXSTPESGPG

SEQ ID NO: 8039 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXGTPESGPG

SEQ ID NO: 8040 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXGTPETPGS

SEQ ID NO: 8041 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXSGSETGTP

SEQ ID NO: 8042 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXGTPEGSAP

SEQ ID NO: 8043 - protein, 66 aa, synthetic construct
  VARIANT 9..58: note = Up to 50 X residues may be deleted
  VARIANT 9..58: note = X can be any amino acid
SGPESGPGXXXXXXXXXXXXXXXXXXXXXXXXXXXXXXXXXXXXXXXXXXXXXXXXXXEPSESATP

SEQ ID NO: 8044 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXSGPESGPG

SEQ ID NO: 8045 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXATPESGPG

SEQ ID NO: 8046 - protein, 46 aa, synthetic construct
  VARIANT 9..38: note = Up to 30 X residues may be deleted
  VARIANT 9..38: note = X can be any amino acid
ATPESGPGXXXXXXXXXXXXXXXXXXXXXXXXXXXXXXATPESGPG

SEQ ID NO: 8047 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXGTSESATP

SEQ ID NO: 8048 - protein, 46 aa, synthetic construct
  VARIANT 9..38: note = Up to 30 X residues may be deleted
  VARIANT 9..38: note = X can be any amino acid
ATPESGPGXXXXXXXXXXXXXXXXXXXXXXXXXXXXXXGTSESATP

SEQ ID NO: 8049 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXTTPESGPG

SEQ ID NO: 8050 - protein, 46 aa, synthetic construct
  VARIANT 9..38: note = Up to 30 X residues may be deleted
  VARIANT 9..38: note = X can be any amino acid
ATPESGPGXXXXXXXXXXXXXXXXXXXXXXXXXXXXXXTTPESGPG

SEQ ID NO: 8051 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXSTPESGPG

SEQ ID NO: 8052 - protein, 46 aa, synthetic construct
  VARIANT 9..38: note = Up to 30 X residues may be deleted
  VARIANT 9..38: note = X can be any amino acid
ATPESGPGXXXXXXXXXXXXXXXXXXXXXXXXXXXXXXSTPESGPG

SEQ ID NO: 8053 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXGTPESGPG

SEQ ID NO: 8054 - protein, 46 aa, synthetic construct
  VARIANT 9..38: note = Up to 30 X residues may be deleted
  VARIANT 9..38: note = X can be any amino acid
ATPESGPGXXXXXXXXXXXXXXXXXXXXXXXXXXXXXXGTPESGPG

SEQ ID NO: 8055 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXGTPETPGS

SEQ ID NO: 8056 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXSGSETGTP

SEQ ID NO: 8057 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXGTPEGSAP

SEQ ID NO: 8058 - protein, 66 aa, synthetic construct
  VARIANT 9..58: note = Up to 50 X residues may be deleted
  VARIANT 9..58: note = X can be any amino acid
ATPESGPGXXXXXXXXXXXXXXXXXXXXXXXXXXXXXXXXXXXXXXXXXXXXXXXXXXEPSESATP

SEQ ID NO: 8059 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXSGPESGPG

SEQ ID NO: 8060 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXATPESGPG

SEQ ID NO: 8061 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXGTSESATP

SEQ ID NO: 8062 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXTTPESGPG

SEQ ID NO: 8063 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXSTPESGPG

SEQ ID NO: 8064 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXGTPESGPG

SEQ ID NO: 8065 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXGTPETPGS

SEQ ID NO: 8066 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXSGSETGTP

SEQ ID NO: 8067 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXGTPEGSAP

SEQ ID NO: 8068 - protein, 66 aa, synthetic construct
  VARIANT 9..58: note = Up to 50 X residues may be deleted
  VARIANT 9..58: note = X can be any amino acid
GTSESATPXXXXXXXXXXXXXXXXXXXXXXXXXXXXXXXXXXXXXXXXXXXXXXXXXXEPSESATP

SEQ ID NO: 8069 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXSGPESGPG

SEQ ID NO: 8070 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXATPESGPG

SEQ ID NO: 8071 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXGTSESATP

SEQ ID NO: 8072 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXTTPESGPG

SEQ ID NO: 8073 - protein, 66 aa, synthetic construct; identical to SEQ ID NO: 8072
  VARIANT 9..38: note = Up to 30 X residues may be deleted
  VARIANT 9..38: note = X can be any amino acid

SEQ ID NO: 8074 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXSTPESGPG

SEQ ID NO: 8075 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXGTPESGPG

SEQ ID NO: 8076 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXGTPETPGS

SEQ ID NO: 8077 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXSGSETGTP

SEQ ID NO: 8078 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXGTPEGSAP

SEQ ID NO: 8079 - protein, 66 aa, synthetic construct
  VARIANT 9..58: note = Up to 50 X residues may be deleted
  VARIANT 9..58: note = X can be any amino acid
TTPESGPGXXXXXXXXXXXXXXXXXXXXXXXXXXXXXXXXXXXXXXXXXXXXXXXXXXEPSESATP

SEQ ID NO: 8080 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXSGPESGPG

SEQ ID NO: 8081 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXATPESGPG

SEQ ID NO: 8082 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXGTSESATP

SEQ ID NO: 8083 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXTTPESGPG

SEQ ID NO: 8084 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXSTPESGPG

SEQ ID NO: 8085 - protein, 46 aa, synthetic construct
  VARIANT 9..38: note = Up to 30 X residues may be deleted
  VARIANT 9..38: note = X can be any amino acid
STPESGPGXXXXXXXXXXXXXXXXXXXXXXXXXXXXXXSTPESGPG

SEQ ID NO: 8086 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXGTPESGPG

SEQ ID NO: 8087 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXGTPETPGS

SEQ ID NO: 8088 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXSGSETGTP

SEQ ID NO: 8089 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXGTPEGSAP

SEQ ID NO: 8090 - protein, 66 aa, synthetic construct
  VARIANT 9..58: note = Up to 50 X residues may be deleted
  VARIANT 9..58: note = X can be any amino acid
STPESGPGXXXXXXXXXXXXXXXXXXXXXXXXXXXXXXXXXXXXXXXXXXXXXXXXXXEPSESATP

SEQ ID NO: 8091 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXSGPESGPG

SEQ ID NO: 8092 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXATPESGPG

SEQ ID NO: 8093 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXGTSESATP

SEQ ID NO: 8094 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXTTPESGPG

SEQ ID NO: 8095 - protein, 46 aa, synthetic construct
  VARIANT 9..38: note = Up to 30 X residues may be deleted
  VARIANT 9..38: note = X can be any amino acid
GTPESGPGXXXXXXXXXXXXXXXXXXXXXXXXXXXXXXTTPESGPG

SEQ ID NO: 8096 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXSTPESGPG

SEQ ID NO: 8097 - protein, 46 aa, synthetic construct
  VARIANT 9..38: note = Up to 30 X residues may be deleted
  VARIANT 9..38: note = X can be any amino acid
GTPESGPGXXXXXXXXXXXXXXXXXXXXXXXXXXXXXXSTPESGPG

SEQ ID NO: 8098 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXGTPESGPG

SEQ ID NO: 8099 - protein, 46 aa, synthetic construct
  VARIANT 9..38: note = Up to 30 X residues may be deleted
  VARIANT 9..38: note = X can be any amino acid
GTPESGPGXXXXXXXXXXXXXXXXXXXXXXXXXXXXXXGTPESGPG

SEQ ID NO: 8100 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXGTPETPGS

SEQ ID NO: 8101 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXSGSETGTP

SEQ ID NO: 8102 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXGTPEGSAP

SEQ ID NO: 8103 - protein, 66 aa, synthetic construct
  VARIANT 9..58: note = Up to 50 X residues may be deleted
  VARIANT 9..58: note = X can be any amino acid
GTPESGPGXXXXXXXXXXXXXXXXXXXXXXXXXXXXXXXXXXXXXXXXXXXXXXXXXXEPSESATP

SEQ ID NO: 8104 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXSGPESGPG

SEQ ID NO: 8105 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXATPESGPG

SEQ ID NO: 8106 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXGTSESATP

SEQ ID NO: 8107 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXTTPESGPG

SEQ ID NO: 8108 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXSTPESGPG

SEQ ID NO: 8109 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXGTPESGPG

SEQ ID NO: 8110 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXGTPETPGS

SEQ ID NO: 8111 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXSGSETGTP

SEQ ID NO: 8112 - protein, 46 aa, synthetic construct
  VARIANT 9..38: note = Up to 30 X residues may be deleted
  VARIANT 9..38: note = X can be any amino acid
GTPETPGSXXXXXXXXXXXXXXXXXXXXXXXXXXXXXXSGSETGTP

SEQ ID NO: 8113 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXGTPEGSAP

SEQ ID NO: 8114 - protein, 66 aa, synthetic construct
  VARIANT 9..58: note = Up to 50 X residues may be deleted
  VARIANT 9..58: note = X can be any amino acid
GTPETPGSXXXXXXXXXXXXXXXXXXXXXXXXXXXXXXXXXXXXXXXXXXXXXXXXXXEPSESATP

SEQ ID NO: 8115 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXSGPESGPG

SEQ ID NO: 8116 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXATPESGPG

SEQ ID NO: 8117 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXGTSESATP

SEQ ID NO: 8118 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXTTPESGPG

SEQ ID NO: 8119 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXSTPESGPG

SEQ ID NO: 8120 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXGTPESGPG

SEQ ID NO: 8121 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXGTPETPGS

SEQ ID NO: 8122 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXSGSETGTP

SEQ ID NO: 8123 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXGTPEGSAP

SEQ ID NO: 8124 - protein, 66 aa, synthetic construct
  VARIANT 9..58: note = Up to 50 X residues may be deleted
  VARIANT 9..58: note = X can be any amino acid
SGSETGTPXXXXXXXXXXXXXXXXXXXXXXXXXXXXXXXXXXXXXXXXXXXXXXXXXXEPSESATP

SEQ ID NO: 8125 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXSGPESGPG

SEQ ID NO: 8126 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXATPESGPG

SEQ ID NO: 8127 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXGTSESATP

SEQ ID NO: 8128 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXTTPESGPG

SEQ ID NO: 8129 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXSTPESGPG

SEQ ID NO: 8130 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXGTPESGPG

SEQ ID NO: 8131 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXGTPETPGS

SEQ ID NO: 8132 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXSGSETGTP

SEQ ID NO: 8133 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXGTPEGSAP

SEQ ID NO: 8134 - protein, 66 aa, synthetic construct
  VARIANT 9..58: note = Up to 50 X residues may be deleted
  VARIANT 9..58: note = X can be any amino acid
GTPEGSAPXXXXXXXXXXXXXXXXXXXXXXXXXXXXXXXXXXXXXXXXXXXXXXXXXXEPSESATP

SEQ ID NO: 8135 - protein, 46 aa, synthetic construct
  VARIANT 9..38: note = Up to 30 X residues may be deleted
  VARIANT 9..38: note = X can be any amino acid
GTPEGSAPXXXXXXXXXXXXXXXXXXXXXXXXXXXXXXEPSESATP

SEQ ID NO: 8136 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXSGPESGPG

SEQ ID NO: 8137 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXATPESGPG

SEQ ID NO: 8138 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXGTSESATP

SEQ ID NO: 8139 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXTTPESGPG

SEQ ID NO: 8140 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXSTPESGPG

SEQ ID NO: 8141 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXGTPESGPG

SEQ ID NO: 8142 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXGTPETPGS

SEQ ID NO: 8143 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXSGSETGTP

SEQ ID NO: 8144 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXGTPEGSAP

SEQ ID NO: 8145 - protein, 66 aa, synthetic construct
  VARIANT 9..58: note = Up to 50 X residues may be deleted
  VARIANT 9..58: note = X can be any amino acid
EPSESATPXXXXXXXXXXXXXXXXXXXXXXXXXXXXXXXXXXXXXXXXXXXXXXXXXXEPSESATP

SEQ ID NO: 8146 - protein, 8 aa, synthetic construct
PGTGTSAT

SEQ ID NO: 8147 - protein, 7 aa, synthetic construct
PGSGPGT

SEQ ID NO: 8148 - protein, 8 aa, synthetic construct
PGTTPGTT

SEQ ID NO: 8149 - protein, 8 aa, synthetic construct
PGTPPTST

SEQ ID NO: 8150 - protein, 8 aa, synthetic construct
PGTSPSAT

SEQ ID NO: 8151 - protein, 8 aa, synthetic construct
PGTGSAGT

SEQ ID NO: 8152 - protein, 8 aa, synthetic construct
PGTGGAGT

SEQ ID NO: 8153 - protein, 8 aa, synthetic construct
PGTSPGAT

SEQ ID NO: 8154 - protein, 8 aa, synthetic construct
PGTSGSGT

SEQ ID NO: 8155 - protein, 8 aa, synthetic construct
PGTSSAST

SEQ ID NO: 8156 - protein, 8 aa, synthetic construct
PGTGAGTT

SEQ ID NO: 8157 - protein, 8 aa, synthetic construct
PGTGSTST

SEQ ID NO: 8158 - protein, 8 aa, synthetic construct
GSEPATSG

SEQ ID NO: 8159 - protein, 8 aa, synthetic construct
APGTSTEP

SEQ ID NO: 8160 - protein, 8 aa, synthetic construct
PGTAGSGT

SEQ ID NO: 8161 - protein, 8 aa, synthetic construct
PGTSSGGT

SEQ ID NO: 8162 - protein, 8 aa, synthetic construct
PGTAGPAT

SEQ ID NO: 8163 - protein, 8 aa, synthetic construct
PGTPGTGT

SEQ ID NO: 8164 - protein, 8 aa, synthetic construct
PGTGGPTT

SEQ ID NO: 8165 - protein, 8 aa, synthetic construct
PGTGSGST

SEQ ID NO: 8166 - protein, 4 aa, synthetic construct
TGTS

SEQ ID NO: 8167 - protein, 4 aa, synthetic construct
TTPG

SEQ ID NO: 8168 - protein, 4 aa, synthetic construct
TPPT

SEQ ID NO: 8169 - protein, 4 aa, synthetic construct
TSPS

SEQ ID NO: 8170 - protein, 4 aa, synthetic construct
TGSA

SEQ ID NO: 8171 - protein, 4 aa, synthetic construct
TGGA

SEQ ID NO: 8172 - protein, 4 aa, synthetic construct
TSPG

SEQ ID NO: 8173 - protein, 4 aa, synthetic construct
TSGS

SEQ ID NO: 8174 - protein, 4 aa, synthetic construct
TSSA

SEQ ID NO: 8175 - protein, 4 aa, synthetic construct
TGAG

SEQ ID NO: 8176 - protein, 4 aa, synthetic construct
TGST

SEQ ID NO: 8177 - protein, 4 aa, synthetic construct
EPAT

SEQ ID NO: 8178 - protein, 4 aa, synthetic construct
GTST

SEQ ID NO: 8179 - protein, 4 aa, synthetic construct
TAGS

SEQ ID NO: 8180 - protein, 4 aa, synthetic construct
TSSG

SEQ ID NO: 8181 - protein, 4 aa, synthetic construct
TAGP

SEQ ID NO: 8182 - protein, 4 aa, synthetic construct
TPGT

SEQ ID NO: 8183 - protein, 4 aa, synthetic construct
TGGP

SEQ ID NO: 8184 - protein, 4 aa, synthetic construct
TGSG

SEQ ID NO: 8185 - protein, 10 aa, synthetic construct
ASSATPESGP

SEQ ID NO: 8186 - protein, 7 aa, synthetic construct
ATPESGP

SEQ ID NO: 8187 - protein, 11 aa, synthetic construct
GTSESAGEPEA

SEQ ID NO: 8188 - protein, 58 aa, synthetic construct
  VARIANT 5..54: note = Up to 50 X residues may be deleted
  VARIANT 5..54: note = X can be any amino acid
PEGSXXXXXXXXXXXXXXXXXXXXXXXXXXXXXXXXXXXXXXXXXXXXXXXXXXPESG

SEQ ID NO: 8189 - protein, 58 aa, synthetic construct
  VARIANT 5..54: note = Up to 50 X residues may be deleted
  VARIANT 5..54: note = X can be any amino acid
PEGSXXXXXXXXXXXXXXXXXXXXXXXXXXXXXXXXXXXXXXXXXXXXXXXXXXSEGG

SEQ ID NO: 8190 - protein, 28 aa, synthetic construct
  VARIANT 5..24: note = Up to 20 X residues may be deleted
  VARIANT 5..24: note = X can be any amino acid
PEGSXXXXXXXXXXXXXXXXXXXXSEGG

SEQ ID NO: 8191 - protein, 58 aa, synthetic construct
  VARIANT 5..54: note = Up to 50 X residues may be deleted
  VARIANT 5..54: note = X can be any amino acid
PEGSXXXXXXXXXXXXXXXXXXXXXXXXXXXXXXXXXXXXXXXXXXXXXXXXXXSETG

SEQ ID NO: 8192 - protein, 58 aa, synthetic construct
  VARIANT 5..54: note = Up to 50 X residues may be deleted
  VARIANT 5..54: note = X can be any amino acid
PEGSXXXXXXXXXXXXXXXXXXXXXXXXXXXXXXXXXXXXXXXXXXXXXXXXXXSESA

SEQ ID NO: 8193 - protein, 58 aa, synthetic construct
  VARIANT 5..54: note = Up to 50 X residues may be deleted
  VARIANT 5..54: note = X can be any amino acid
PESGXXXXXXXXXXXXXXXXXXXXXXXXXXXXXXXXXXXXXXXXXXXXXXXXXXPESG

SEQ ID NO: 8194 - protein, 28 aa, synthetic construct
  VARIANT 5..24: note = Up to 20 X residues may be deleted
  VARIANT 5..24: note = X can be any amino acid
PESGXXXXXXXXXXXXXXXXXXXXPESG

SEQ ID NO: 8195 - protein, 58 aa, synthetic construct
  VARIANT 5..54: note = Up to 50 X residues may be deleted
  VARIANT 5..54: note = X can be any amino acid
PESGXXXXXXXXXXXXXXXXXXXXXXXXXXXXXXXXXXXXXXXXXXXXXXXXXXSEGG

SEQ ID NO: 8196 - protein, 58 aa, synthetic construct
  VARIANT 5..54: note = Up to 50 X residues may be deleted
  VARIANT 5..54: note = X can be any amino acid
PESGXXXXXXXXXXXXXXXXXXXXXXXXXXXXXXXXXXXXXXXXXXXXXXXXXXSETG

SEQ ID NO: 8197 - protein, 58 aa, synthetic construct
  VARIANT 5..54: note = Up to 50 X residues may be deleted
  VARIANT 5..54: note = X can be any amino acid
PESGXXXXXXXXXXXXXXXXXXXXXXXXXXXXXXXXXXXXXXXXXXXXXXXXXXSESA

SEQ ID NO: 8198 - protein, 28 aa, synthetic construct
  VARIANT 5..24: note = Up to 20 X residues may be deleted
  VARIANT 5..24: note = X can be any amino acid
PESGXXXXXXXXXXXXXXXXXXXXSESA

SEQ ID NO: 8199 - protein, 58 aa, synthetic construct
  VARIANT 5..54: note = Up to 50 X residues may be deleted
  VARIANT 5..54: note = X can be any amino acid
PETPXXXXXXXXXXXXXXXXXXXXXXXXXXXXXXXXXXXXXXXXXXXXXXXXXXPESG

SEQ ID NO: 8200 - protein, 58 aa, synthetic construct
  VARIANT 5..54: note = Up to 50 X residues may be deleted
  VARIANT 5..54: note = X can be any amino acid
PETPXXXXXXXXXXXXXXXXXXXXXXXXXXXXXXXXXXXXXXXXXXXXXXXXXXSEGG

SEQ ID NO: 8201 - protein, 58 aa, synthetic construct
  VARIANT 5..54: note = Up to 50 X residues may be deleted
  VARIANT 5..54: note = X can be any amino acid
PETPXXXXXXXXXXXXXXXXXXXXXXXXXXXXXXXXXXXXXXXXXXXXXXXXXXSETG

SEQ ID NO: 8202 - protein, 28 aa, synthetic construct
  VARIANT 5..24: note = Up to 20 X residues may be deleted
  VARIANT 5..24: note = X can be any amino acid
PETPXXXXXXXXXXXXXXXXXXXXSETG

SEQ ID NO: 8203 - protein, 58 aa, synthetic construct
  VARIANT 5..54: note = Up to 50 X residues may be deleted
  VARIANT 5..54: note = X can be any amino acid
PETPXXXXXXXXXXXXXXXXXXXXXXXXXXXXXXXXXXXXXXXXXXXXXXXXXXSESA

SEQ ID NO: 8204 - protein, 109 aa, synthetic construct
  VARIANT 26: note = X can be T or N
  VARIANT 31: note = X can be T or S
  VARIANT 87: note = X can be E or V
  VARIANT 95: note = X can be S or P
ELVVTQEPSLTVSPGGTVTLTCRSSXGAVTXSNYANWVQQKPGQAPRGLIGGTNKRAPGTPARFSGSLLGGKAALTLSGVQPEDEAXYYCALWYXNLWVFGGGTKLTVL

SEQ ID NO: 8205 - protein, 125 aa, synthetic construct
  VARIANT 5: note = X can be V or L
  VARIANT 19: note = X can be R or K
  VARIANT 30: note = X can be S or N
  VARIANT 49: note = X can be G or A
  VARIANT 53: note = X can be T or S
  VARIANT 55: note = X can be R or Y
  VARIANT 68: note = X can be G or D
  VARIANT 81: note = X can be V or A
  VARIANT 87: note = X can be S or N
  VARIANT 102: note = X can be E or G
  VARIANT 114: note = X can be H or Y
EVQLXESGGGJVQPGGSLXLSCAASGFTFXTYAMNWVRQAPGKGLEWVXRIRXKXNNYATYYADSVKXRFTISRDDSKNTXYLQMNXLKTEDTAVYYCVRHXNFGNSYVSWFAXWGQGTLVTVSS

SEQ ID NO: 8206 - protein, 25 aa, synthetic construct
QVQLQESGPGLVKPSETLSLTCTVS

SEQ ID NO: 8207 - protein, 14 aa, synthetic construct
WIRQPPGKGLEWIG

SEQ ID NO: 8208 - protein, 32 aa, synthetic construct
RVTISVDTSKNQFSLKLSSVTAADTAVYYCAR

SEQ ID NO: 8209 - protein, 23 aa, synthetic construct
DIQMTQSPSSLSASVGDRVTITC

SEQ ID NO: 8210 - protein, 15 aa, synthetic construct
WYQQKPGKAPKLLIY

SEQ ID NO: 8211 - protein, 32 aa, synthetic construct
GVPSRFSGSGSGTDFTFTISSLQPEDIATYYC

SEQ ID NO: 8212 - protein, 10 aa, synthetic construct
FGQGTKVEIK

SEQ ID NO: 8213 - protein, 23 aa, synthetic construct
EIVLTQSPGTLSLSPGERATLSC

SEQ ID NO: 8214 - protein, 23 aa, synthetic construct
EIVLTQSPATLSLSPGERATLSC

SEQ ID NO: 8215 - protein, 15 aa, synthetic construct
WYQQKPGQAPRLLIY

SEQ ID NO: 8216 - protein, 32 aa, synthetic construct
GVPSRFSGSGSGTDFTFTISSLQPEDIATYFC

SEQ ID NO: 8217 - protein, 32 aa, synthetic construct
GVPSRFSGSGSGTDFTLTISSLQPEDFATYYC

SEQ ID NO: 8218 - protein, 32 aa, synthetic construct
GIPDRFSGSGSGTDFTLTISRLEPEDFAVYYC

SEQ ID NO: 8219 - protein, 32 aa, synthetic construct
GIPARFSGSGSGTDFTLTISSLEPEDFAVYYC

SEQ ID NO: 8220 - protein, 32 aa, synthetic construct
GVPSRFSGSGSGTDFTLTISSLQPEDFATYFC

SEQ ID NO: 8221 - protein, 10 aa, synthetic construct
FGGGTKVEIK

SEQ ID NO: 8222 - protein, 20 aa, synthetic construct
STPESGPGTGSGSTPESGPG

SEQ ID NO: 8223 - protein, 25 aa, synthetic construct [sequence omitted]

SEQ ID NO: 8224 - protein, 25 aa, synthetic construct [sequence omitted]

SEQ ID NO: 8225 - protein, 25 aa, synthetic construct
EVQLLESGGGLVQPGGSLRLSCAAS

SEQ ID NO: 8226 - protein, 25 aa, synthetic construct
QVQLVESGGGVVQPGRSLRLSCAAS

SEQ ID NO: 8227 - protein, 25 aa, synthetic construct [sequence omitted]

SEQ ID NO: 8228 - protein, 25 aa, synthetic construct [sequence omitted]

SEQ ID NO: 8229 - DNA, 4359 bp, synthetic construct
  source 1..4359: mol_type = other DNA
gcatcttcggcgacgccggaaagcggtccgggtacgtccaccgaaccgagcgagggtagcgctccgggcaccagcgagtccgcgaccccggaaagcggtccgggtagcggtccgggcacctccgagagcgcgaccccgggcacctctgaatcagccaccccggagtctggcccaggtagcgagccggcaacctctggcagcgaaaccccgggcaccagcgaatccgcgacgccagagagcggtccgggcacctctacggagcctagcgagggctcagcaccaggtagccctgcaggttccccgacgtcaaccgaggaaggtacaagcgaaagcgccacccctgagtcgggccctggcagcgaaccggcaactagcggcagcgagactccgggtaccagcgagtctgctacgccagagagcggcccaggttcgccagcgggttcgccgactagcacggaggagggcagcccagcgggtagccctaccagcactgaagagggtacgtccaccgaaccgagcgaaggtagcgcaccaggtacctccgagtctgccacccctgaatccggtccaggtaccagcgaatcagccaccccggagtcgggtccaggtacgagcgaatctgctaccccggaatccggcccaggcagcgaacctgctactagcggcagcgaaacgccgggcagcgaacctgccacgtcaggcagcgagacgccgggttcccctgcaggctccccgaccagcactgaggagggcacctccaccgaaccatcagaaggtagcgcgcctggtacgtcaaccgaaccttccgagggcagcgcaccgggttcagaaccagctacgtctgggagcgagaccccgggcacctccgagtcggcgaccccggaggcaggtcgttctgctagccatacccctgcagggttaactggccccggaacttcagaaagtgctacacccgagtctgacatccagatgacccagagcccgagcagcctgagcgcgagcgtgggtgatcgtgttaccattacctgccaggcctcccaggacatttctaactatctgaactggtaccagcaaaagccgggtaaagcgccgaagctgctgatctatgatgcttctaacctggaaacgggtgttccgagccgtttcagcggtagcggcagcggtaccgacttcacctttaccatcagcagcctgcagccggaggatattgcgacctactattgccagcattttgatcatctgccgctggcgttcggtcagggcaccaaggtggagatcaaatcggaatcagcgacacctgaatctggccctggtacaagtcccggcgcaacgcccgaatcgggtccggggacgagtgaatctgcgacaccgcaggtgcaactgcaggagagcggtccgggcctggttaagccgagcgaaaccctgagcctgacctgcaccgtgagcggtggcagcgtgagcagcggcgattattattggacctggattcgtcagccgccgggcaagggtctggagtggattggtcatatttattattccggtaacaccaactacaacccgagcctgaaaagccgtgtgaccatcagcgttgacaccagcaagaaccagttcagcctgaaactgagcagcgtgaccgcggcggataccgcggtttactattgcgcgcgtgatcgtgtgaccggcgcgttcgacatttggggtcagggcaccctggtgacggttagcagcggtggtggcggcagcgagttagttgtgacccaagagccgagcctgaccgttagcccgggtggtacggtcaccctgacgtgccgtagcagcaacggtgcggtcacgagcagcaactatgccaattgggtccagcagaaaccgggtcaagcaccgcgtggcctgatcggcggcaccaataaacgtgccccgggtactcctgcgcgtttctccggtagcctgctggaaggcaaagccgctctgaccctgagcggtgtccagccggaagatgaagcggtgtactactgcgcgctgtggtatccgaatctgtgggtttttggcggcggtaccaagctgaccgtattgagcgagagcgcaacgccagagagcggtccaggcaccagcccaggtgccacccctgagagcggcccaggtacttctgagagcgccactccggaggtccaactggtggagtctggtggtggcattgttcaaccgggtggctcgttgcgcctgagctgtgcagctagcggctttaccttcagcacctatgcgatgaattgggttcgtcaggcaccgggtaagggcctggaatgggtgggccgtatccgcaccaagcgcaacgattacgcgacctactacgcggatagcgttaaaggccgcttcacgattagccgtgacgattccaagaatacgctgtatctgcaaatgaacagcctgaaaaccgaagataccgcggtgtattactgtgtgcgccacgaaaatttcggcaacagctacgtgagctggtttgcacattggggtcagggcaccctggttacggtgagctccggtacagctactccagaatcaggacccggggaagctggaagaagcgcctcacacacaccagctggacttacaggcccggctactcccgaaagtgggccaggaacatcagagtccgcgaccccggaaagcggtccgggttctccagctggcagcccgacctccactgaagaaggcacctctgagtctgctacccctgaatctggtcctggctccgaacctgctacctctggttccgaaactccaggtacctcggaatctgcgactccggaatctggcccgggcacgagcacggagccgtctgagggtagcgcaccaggtaccagcactgagccttctgagggctctgcaccgggtacctccacggaaccttcggaaggttctgcgccgggtacctccactgagccatccgagggttcagcaccaggtactagcacggaaccgtccgagggctctgcaccaggtacgagcaccgaaccgtcggagggtagcgctccaggtagcccagcgggctctccgacaagcaccgaagaaggcaccagcaccgagccgtccgaaggttccgcaccaggtacaagcgagagcgcgactcctgaatctggtccgggtagcgagcctgcaaccagcggttctgagacgccgggcacttccgaatctgcgaccccggagtccggtccaggttcagagccggcgacgagcggttcggaaacgccgggtacgtctgaatcagccacgccggagtctggtccgggtacctcgaccgaaccaagcgaaggttcggcaccgggtactagcgagagcgcaacccctgaaagcggtccgggcagcccggcaggttctccaaccagcaccgaagaaggttcccctgctggtagcccgacctctacggaggaaggtagccctgcaggttccccaacttctactgaggaaggtacttctgagtccgctaccccagaaagcggtcctggtacctccactgaaccgtctgaaggctctgcaccaggcacttctgagtctgctactccagaaagcggcccaggttctgaaccagcaacttctggctctgagactccaggcacttctgagtccgcaacgcctgaatccggtcctggttctgaaccagctacttccggcagcgaaaccccaggtacctctgagtctgcgactccagagtctggtcctggtacttccactgagcctagcgagggttccgcaccaggttctccggctggtagcccgaccagcacggaggagggtacgtctgaatctgcaacgccggaatcgggcccaggttcggagcctgcaacgtctggcagcgaaaccccgggtacctccgaatctgctacaccggaaagcggtcctggcagccctgctggttctccaacctctaccgaggagggttcaccggcaggtagcccgactagcactgaagaaggtactagcacggagccgagcgagggtagtgctccgggtacgagcgagagcgcaacgccagagagcggtccaggcaccagcgaatcggccacccctgagagcggcccaggtacttcaccctctgctacgccggaaagcggtccgggttccgagccggcgaccagcggctccgagactccgggttcggagccggcgacctccggctcggaaaccccgggtagcccggctggttctccgaccagcactgaggaaggcaccagcaccgaaccaagcgagggcagcgcgccaggtacgagcaccgaaccgagcgagggttcagcccctggctctgagccggcgacgtctggctccgaaaccccgggcaccagcgagagcgctggtgaaccggaagcg

SEQ ID NO: 8230 - protein, 25 aa, synthetic construct
EVQLVQSGAEVKKPGESLKISCKGS

SEQ ID NO: 8231 - protein, 25 aa, synthetic construct
QVQLVQSGSELKKPGASVKVSCKAS

SEQ ID NO: 8232 - protein, 25 aa, synthetic construct
QVQLVQSGVEVKKPGASVKVSCKAS

SEQ ID NO: 8233 - protein, 14 aa, synthetic construct
WIRQSPGKGLEWIG

SEQ ID NO: 8234 - protein, 14 aa, synthetic construct
WVRQAPGQGLEWMG

SEQ ID NO: 8235 - protein, 14 aa, synthetic construct
WVRQAPGKGLEWVS

SEQ ID NO: 8236 - protein, 14 aa, synthetic construct
WVRQMPGKGLEWMG

SEQ ID NO: 8237 - protein, 32 aa, synthetic construct
RLTISIDTSKTQFSLKLSSVTAADTAIYYCVR

SEQ ID NO: 8238 - protein, 32 aa, synthetic construct
RVTSTRDTSISTAYMELSRLRSDDTVVYYCAR

SEQ ID NO: 8239 - protein, 32 aa, synthetic construct
RVTMTRDTSTSTVYMELSSLRSEDTAVYYCAR

SEQ ID NO: 8240 - protein, 32 aa, synthetic construct
RVTITADESTSTAYMELSSLRSEDTAVYYCAR

SEQ ID NO: 8241 - protein, 32 aa, synthetic construct
RFTISRDNSKNTLYLQMNSLRAEDTAVYYCAK

SEQ ID NO: 8242 - protein, 32 aa, synthetic construct
RFTISRDNSKNTLYLQMNSLRAEDTAVYYCAR

SEQ ID NO: 8243 - protein, 32 aa, synthetic construct
RFTISRDNAKNSLYLQMNSLRAEDTAVYYCAR

SEQ ID NO: 8244 - protein, 32 aa, synthetic construct
QVTISADKSISTAYLQWSSLKASDTAMYYCAR

SEQ ID NO: 8245 - protein, 32 aa, synthetic construct
RFVFSLDTSVSTAYLQICSLKAEDTAVYYCAR

SEQ ID NO: 8246 - protein, 32 aa, synthetic construct
RVTLTTDSSTTTAYMELKSLQFDDTAVYYCAR

SEQ ID NO: 8247 - protein, 32 aa, synthetic construct
RLTISRDNSKNTLYLQMNSLRAEDTAVYYCVR

SEQ ID NO: 8248 - protein, 32 aa, synthetic construct
RLTISRDNAKNSLYLQMNSLRAEDTAVYYCVR

SEQ ID NO: 8249 - protein, 32 aa, synthetic construct
RLTITADESTSTAYMELSSLRSEDTAVYYCVR

SEQ ID NO: 8250 - protein, 109 aa, synthetic construct
ELVVTQEPSLTVSPGGTVTLTCRSSNGAVTSSNYANWVQQKPGQAPRGLIGGTNKRAPGTPARFSGSALGGKAALTLSGVQPEDEAVYYCALWYPNLWVFGGGTKLTVL

SEQ ID NO: 8251 - protein, 109 aa, synthetic construct
ELVVTQEPSLTVSPGGTVTLTCRSSNGAVTSSNYANWVQQKPGQAPRGLIGGTNKRAPGTPARFSGSGLGGKAALTLSGVQPEDEAVYYCALWYPNLWVFGGGTKLTVL

SEQ ID NO: 8252 - protein, 109 aa, synthetic construct
ELVVTQEPSLTVSPGGTVTLTCRSSNGAVTSSNYANWVQQKPGQAPRGLIGGTNKRAPGTPARFSGSLNGGKAALTLSGVQPEDEAVYYCALWYPNLWVFGGGTKLTVL

SEQ ID NO: 8253 - protein, 109 aa, synthetic construct
ELVVTQEPSLTVSPGGTVTLTCRSSNGAVTSSNYANWVQQKPGQAPRGLIGGTNKRAPGTPARFSGSLEGGKAALTLSGVQPEDEAVYYCALWYPNLWVFGGGTKLTVL

SEQ ID NO: 8254 - protein, 109 aa, synthetic construct
ELVVTQEPSLTVSPGGTVTLTCRSSNGAVTSSNYANWVQQKPGQAPRGLIGGTNKRAPGTPARFSGSLGGGKAALTLSGVQPEDEAVYYCALWYPNLWVFGGGTKLTVL

SEQ ID NO: 8255 - protein, 109 aa, synthetic construct
ELVVTQEPSLTVSPGGTVTLTCRSSNGAVTSSNYANWVQQKPGQAPRGLIGGTNKRAPGTPARFSGSLLGGKAGLTLSGVQPEDEAVYYCALWYPNLWVFGGGTKLTVL

SEQ ID NO: 8256 - protein, 125 aa, synthetic construct
EVQLVESGGGIVQPGGSLRLSCAASGFTFSTYAMNWVRQAPGKGLEWVGRIRTKRNDYATYYADSVKGRFTISRDDSKNTAYLQMNSLKTEDTAVYYCVRHENFGNSYVSWFAHWGQGTLVTVSS

SEQ ID NO: 8257 - protein, 125 aa, synthetic construct
EVQLVESGGGIVQPGGSLRLSCAASGFTFNTYAMNWVRQAPGKGLEWVGRIRTKTNDYATYYADSVKGRFTISRDDSKNTAYLQMNSLKTEDTAVYYCVRHENFGNSYVSWFAHWGQGTLVTVSS

SEQ ID NO: 8258 - protein, 125 aa, synthetic construct
EVQLVESGGGIVQPGGSLRLSCAASGFTFNTYAMNWVRQAPGKGLEWVGRIRTKTNDYATYYADSVKGRFTISRDDSKNTLYLQMNSLKTEDTAVYYCVRHENFGNSYVSWFAHWGQGTLVTVSS

SEQ ID NO: 8259 - protein, 125 aa, synthetic construct
EVQLVESGGGIVQPGGSLRLSCAASGFTFSTYAMNWVRQAPGKGLEWVGRIRTKTNDYATYYADSVKGRFTISRDDSKNTAYLQMNSLKTEDTAVYYCVRHENFGNSYVSWFAHWGQGTLVTVSS

SEQ ID NO: 8260 - protein, 125 aa, synthetic construct
EVQLVESGGGIVQPGGSLRLSCAASGFTFSTYAMNWVRQAPGKGLEWVGRIRTKTNDYATYYADSVKGRFTISRDDSKNTLYLQMNSLKTEDTAVYYCVRHENFGNSYVSWFAHWGQGTLVTVSS

SEQ ID NO: 8261 - protein, 125 aa, synthetic construct
EVQLVESGGGIVQPGGSLRLSCAASGFTFSTYAMNWVRQAPGKGLEDVGRIRTKRNNYATYYADSVKGRFTISRDDSKNTVYLQMNSLKTEDTAVYYCVRHENFGNSYVSWFAHWGQGTLVTVSS

SEQ ID NO: 8262 - protein, 125 aa, synthetic construct
EVQLVESGGGIVQPGGSLRLSCAASGFTFSTYAMNWVRQAPGKGLEWGGRIRTKRNNYATYYADSVKGRFTISRDDSKNTVYLQMNSLKTEDTAVYYCVRHENFGNSYVSWFAHWGQGTLVTVSS

SEQ ID NO: 8263 - protein, 125 aa, synthetic construct
EVQLVESGGGIVQPGGSLRLSCAASGFTFSTYAMNWVRQAPGKGLEWVGRIRTPRNNYATYYADSVKGRFTISRDDSKNTVYLQMNSLKTEDTAVYYCVRHENFGNSYVSWFAHWGQGTLVTVSS

SEQ ID NO: 8264 - protein, 125 aa, synthetic construct
EVQLVESGGGIVQPGGSLRLSCAASGFTFSTYAMNWVRQAPGKGLEWVGRIRTKPNNYATYYADSVKGRFTISRDDSKNTVYLQMNSLKTEDTAVYYCVRHENFGNSYVSWFAHWGQGTLVTVSS

SEQ ID NO: 8265 - protein, 125 aa, synthetic construct
EVQLVESGGGIVQPGGSLRLSCAASGFTFSTYAMNWVRQAPGKGLEWVGRIRTKRNNYATTYADSVKGRFTISRDDSKNTVYLQMNSLKTEDTAVYYCVRHENFGNSYVSWFAHWGQGTLVTVSS

SEQ ID NO: 8266 - protein, 125 aa, synthetic construct
EVQLVESGGGIVQPGGSLRLSCAASGFTFSTYAMNWVRQAPGKGLEWVGRIRTKRNNYATYDADSVKGRFTISRDDSKNTVYLQMNSLKTEDTAVYYCVRHENFGNSYVSWFAHWGQGTLVTVSS

SEQ ID NO: 8267 - protein, 125 aa, synthetic construct
EVQLVESGGGIVQPGGSLRLSCAASGFTFSTYAMNWVRQAPGKGLEWVGRIRTKRNNYATYWADSVKGRFTISRDDSKNTVYLQMNSLKTEDTAVYYCVRHENFGNSYVSWFAHWGQGTLVTVSS

SEQ ID NO: 8268 - protein, 125 aa, synthetic construct
EVQLVESGGGIVQPGGSLRLSCAASGFTFSTYAMNWVRQAPGKGLEWVGRIRTKRNNYTTYYADSVKGRFTISRDDSKNTVYLQMNSLKTEDTAVYYCVRHENFGNSYVSWFAHWGQGTLVTVSS

SEQ ID NO: 8269 - protein, 125 aa, synthetic construct
EVQLVESGGGIVQPGGSLRLSCAASGFTFSTYAMNWVRQAPGKGLEWVGRIRTKRNNYATYYADSVKGRFTISRDDSKNTVYLQMNSLKTEDTAVYYCVRHENFGASYVSWFAHWGQGTLVTVSS

SEQ ID NO: 8270 - protein, 125 aa, synthetic construct
EVQLVESGGGIVQPGGSLRLSCAASGFTFSTYAMNWVRQAPGKGLEWVGRIRTKRNNYATYYADSVKGRFTISRDDSKNTVYLQMNSLKTEDTAVYYCVRHENFGNAYVSWFAHWGQGTLVTVSS

SEQ ID NO: 8271 - protein, 20 aa, synthetic construct
SGPESGPGTGTSATPESGPG

SEQ ID NO: 8272 - protein, 19 aa, synthetic construct
ATPESGPGSGPGTSESATP

SEQ ID NO: 8273 - protein, 20 aa, synthetic construct
ATPESGPGTTPGTTPESGPG

SEQ ID NO: 8274 - protein, 20 aa, synthetic construct
ATPESGPGTPPTSTPESGPG

SEQ ID NO: 8275 - protein, 20 aa, synthetic construct
ATPESGPGTSPSATPESGPG

SEQ ID NO: 8276 - protein, 20 aa, synthetic construct
ATPESGPGTGSAGTPESGPG

SEQ ID NO: 8277 - protein, 20 aa, synthetic construct
ATPESGPGTGGAGTPESGPG

SEQ ID NO: 8278 - protein, 20 aa, synthetic construct
ATPESGPGTSPGATPESGPG

SEQ ID NO: 8279 - protein, 20 aa, synthetic construct
GTPESGPGTSGSGTPESGPG

SEQ ID NO: 8280 - protein, 20 aa, synthetic construct
GTPESGPGTSSASTPESGPG

SEQ ID NO: 8281 - protein, 20 aa, synthetic construct
GTPESGPGTGAGTTPESGPG

SEQ ID NO: 8282 - protein, 20 aa, synthetic construct
GTPESGPGTGSTSTPESGPG

SEQ ID NO: 8283 - protein, 20 aa, synthetic construct
GTPETPGSEPATSGSETGTP

SEQ ID NO: 8284 - protein, 20 aa, synthetic construct
GTPEGSAPGTSTEPSESATP

SEQ ID NO: 8285 - protein, 20 aa, synthetic construct
ATPESGPGTAGSGTPESGPG

SEQ ID NO: 8286 - protein, 20 aa, synthetic construct
ATPESGPGTSSGGTPESGPG

SEQ ID NO: 8287 - protein, 20 aa, synthetic construct
ATPESGPGTAGPATPESGPG

SEQ ID NO: 8288 - protein, 20 aa, synthetic construct
ATPESGPGTPGTGTPESGPG

SEQ ID NO: 8289 - protein, 20 aa, synthetic construct
TTPESGPGTGGPTTPESGPG

SEQ ID NO: 8290 - protein, 11 aa, synthetic construct
WGQGTMVTVSS

The invention claimed is:

1. A polypeptide comprising the amino acid sequence of SEQ ID NO:1000.

2. The polypeptide of claim 1, which consists of the amino acid sequence of SEQ ID NO: 1000.

3. A pharmaceutical composition, comprising the polypeptide of claim 1 and one or more pharmaceutically suitable excipients.

4. A method of treating a cancer in a subject, comprising administering to the subject the pharmaceutical composition of claim 3, wherein the cancer is characterized with expression of epidermal growth factor receptor (EGFR).

5. The method of claim 4, wherein the cancer is selected from the group consisting of lung cancer, colorectal cancer, head and neck cancer, breast cancer, pancreatic cancer, brain cancer, liver cancer, kidney cancer, ovarian cancer, prostate cancer, esophageal cancer, cervical cancer, and bladder cancer.

6. A polynucleotide encoding the polypeptide of claim 1.

7. A vector, comprising the polynucleotide of claim 6 and a recombinant regulatory sequence operably linked to the polynucleotide.

8. A host cell, comprising the vector of claim 7.

* * * * *